US011634741B2

(12) United States Patent
Pech et al.

(10) Patent No.: US 11,634,741 B2
(45) Date of Patent: *Apr. 25, 2023

(54) SYNTHESIS OF L-NUCLEIC ACIDS BY MEANS OF AN ENZYME

(71) Applicant: Aptarion Biotech AG

(72) Inventors: Andreas Pech, Halle (DE); Florian Jarosch, Berlin (DE); Michael Jahnz, Berlin (DE); Sven Klussmann, Berlin (DE); Ralf David, Leipzig (DE)

(73) Assignee: Aptarion biotech AG, Munich (DE)

( * ) Notice: Subject to any disclaimer, the term of this patent is extended or adjusted under 35 U.S.C. 154(b) by 1007 days.

This patent is subject to a terminal disclaimer.

(21) Appl. No.: 15/038,049

(22) PCT Filed: Nov. 20, 2014

(86) PCT No.: PCT/EP2014/003102
§ 371 (c)(1),
(2) Date: Jun. 29, 2016

(87) PCT Pub. No.: WO2015/074756
PCT Pub. Date: May 28, 2015

(65) Prior Publication Data
US 2016/0304926 A1    Oct. 20, 2016

(30) Foreign Application Priority Data

Nov. 20, 2013 (EP) .................... 13005449

(51) Int. Cl.
| C12N 9/12 | (2006.01) |
|---|---|
| C12P 19/34 | (2006.01) |
| C12N 15/10 | (2006.01) |
| C12Q 1/6844 | (2018.01) |
| C12Q 1/6806 | (2018.01) |

(52) U.S. Cl.
CPC ............ *C12P 19/34* (2013.01); *C12N 9/1252* (2013.01); *C12Q 1/6806* (2013.01); *C12Q 1/6844* (2013.01); *C12Y 207/07007* (2013.01)

(58) Field of Classification Search
CPC .. C12N 9/1241; C12N 9/1247; C12N 9/1252; C12N 9/1276
See application file for complete search history.

(56) References Cited

U.S. PATENT DOCUMENTS

| 6,605,713 B1 | 12/2003 | Fuerste et al. |
|---|---|---|
| 9,850,471 B2 * | 12/2017 | Pech ................ C12N 15/115 |
| 2008/0193925 A1 | 8/2008 | Woodgate et al. |
| 2015/0337348 A1 | 11/2015 | Pech et al. |

FOREIGN PATENT DOCUMENTS

| DE | 10156274 | 6/2003 |
|---|---|---|
| WO | 03047743 | 6/2003 |

OTHER PUBLICATIONS

She et al., UniProt Database, Accession No. Q97W02, Aug. 2002.*
GenBank AAA65326.1.
Brewer & Laskowski, "Left-Handed Comments," Science 258:1289, 1992.
Brockman,ed., "Life: What a Concept," Edge 221, Sep. 4, 2007.
Church, "Fabricating with DNA," Fab Lab Forum & Dig Fab Symp, Aug. 22, 2007.
Vater et al., "Turning . . . therapeutics," Drug Disc Today 20:147-155, 2015.
Keefe et al., "Aptamers as therapeutics," Nat Rev 9:537-550, 2010.
Pentelute et al., "X-ray . . . enantiomers," J Am Chem Soc 130:9695-9701, 2008.
Milton et al., "Total . . . HIV-1," Science 256(5062)1445-1448, 1992.

* cited by examiner

*Primary Examiner* — Maryam Monshipouri
(74) *Attorney, Agent, or Firm* — MDIP LLC

(57) ABSTRACT

The present invention is related to a method for adding one or more L-nucleotides to the 3'end of a first L-nucleic acid, wherein the method comprises the step of reacting the one or more L-nucleotides with the first L-nucleic acid in the presence of a protein comprising a mutant enzymatic activity exhibiting moiety, wherein the enzymatic activity is capable of adding one or more L-nucleotides to the 3' end of the first L-nucleic acid, wherein the mutant enzymatic activity exhibiting moiety comprises an amino acid sequence, wherein the amino acids of the amino acid sequence are D-amino acids, wherein the mutant enzymatic activity exhibiting moiety is a variant of an enzymatic activity exhibiting moiety, wherein the enzymatic activity exhibiting moiety consists of an amino acid sequence according to SEQ ID NO: 15 and wherein the amino acids of the amino acid sequence according to SEQ ID NO: 15 are D-amino acids, wherein the amino acid sequence of the mutant enzymatic activity exhibiting moiety differs from the amino acid sequence of the enzymatic activity exhibiting moiety consisting of an amino acid sequence according to SEQ ID NO: 15 at least at one amino acid position, preferably at three amino acid positions, and/or wherein the amino acid sequence of the mutant enzymatic activity exhibiting moiety is a truncated form of an amino acid sequence according to SEQ ID NO: 15, and wherein the amino acid sequence of the mutant enzymatic activity exhibiting moiety is different from an amino acid sequence according to any of SEQ ID NOs 15 to 22 and 51.

15 Claims, 39 Drawing Sheets
Specification includes a Sequence Listing.

(A)

```
                           SP-1 (15-mer)    D(g1)P (17-mer)
Complex 1-gap-A (D) 5'-GATCACAGTGAGTAC GTAAAACGACGGCAGT-3'
                    3'-CTAGTGTCACTCATGACATTTTGCTGCCGGTCA-5'
                                 MJ_1_140_DD (33-mer)

SP-1 (15-mer)    D(g1)P (17-mer)
Complex 1-gap-C (D) 5'-GATCACAGTGAGTAC GTAAAACGACGGCCAGT-3'
                    3'-CTAGTGTCACTCATGCCATTTTGCTGCCGGTCA-5'
                                 MJ_1_141_DD (33-mer)

SP-1 (15-mer)    D(g1)P (17-mer)
Complex 1-gap-G (D) 5'-GATCACAGTGAGTAC GTAAAACGACGGCCAGT-3'
                    3'-CTAGTGTCACTCATGGCATTTTGCTGCCGGTCA-5'
                                 MJ_1_142_DD (33-mer)

SP-1 (15-mer)    D(g1)P (17-mer)
Complex 1-gap-T (D) 5'-GATCACAGTGAGTAC GTAAAACGACGGCCAGT-3'
                    3'-CTAGTGTCACTCATGTCATTTTGCTGCCGGTCA-5'
                                 SP1c+18(g1) (33-mer)
```

(B)

```
                           SP-1 (15-mer)      D(g6)P (12-mer)
Complex 6-gap (D):  5'-GATCACAGTGAGTAC     ACGACGGCCAGT-3'
                    3'-CTAGTGTCACTCATGTTATCTTGCTGCCGGTCA-5'
                                 SP1c+18(g6)  (33-mer)
```

List of SEQ NOS for oligonucleotides as shown:

| Name | Sequence (5'→3') |
|---|---|
| SP-1 | GATCACAGTGAGTAC [SEQ ID NO:36] |
| D(g1)P | Phosphate-GTAAAACGACGGCCAGT [SEQ ID NO:37] |
| MJ_1_140_DD | ACTGGCCGTCGTTTTACAGTACTCACTGTGATC [SEQ ID NO:38] |
| MJ_1_141_DD | ACTGGCCGTCGTTTTACCGTACTCACTGTGATC [SEQ ID NO:39] |
| MJ_1_142_DD | ACTGGCCGTCGTTTTACGGTACTCACTGTGATC [SEQ ID NO:40] |
| SP1c+18(g1) | ACTGGCCGTCGTTTTACTGTACTCACTGTGATC [SEQ ID NO:41] |
| SP1c+18(g6) | ACTGGCCGTCGTTCTATTGTACTCACTGTGATC [SEQ ID NO:14] |

Fig. 1

(A)
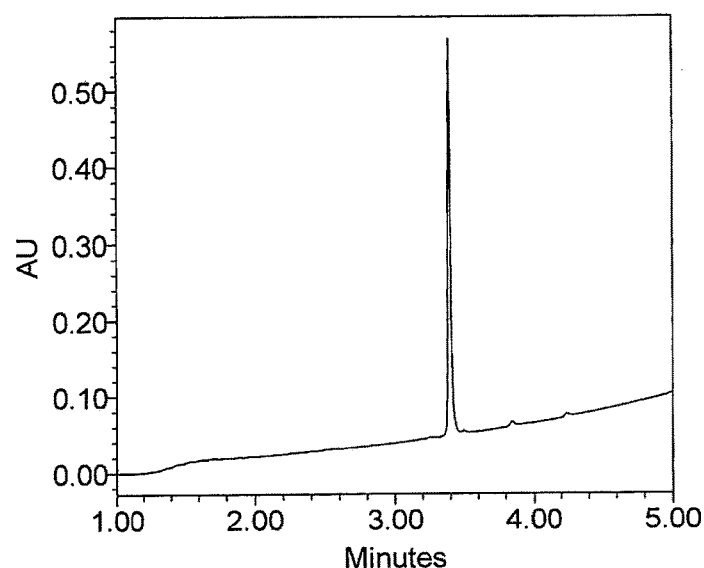
(B)
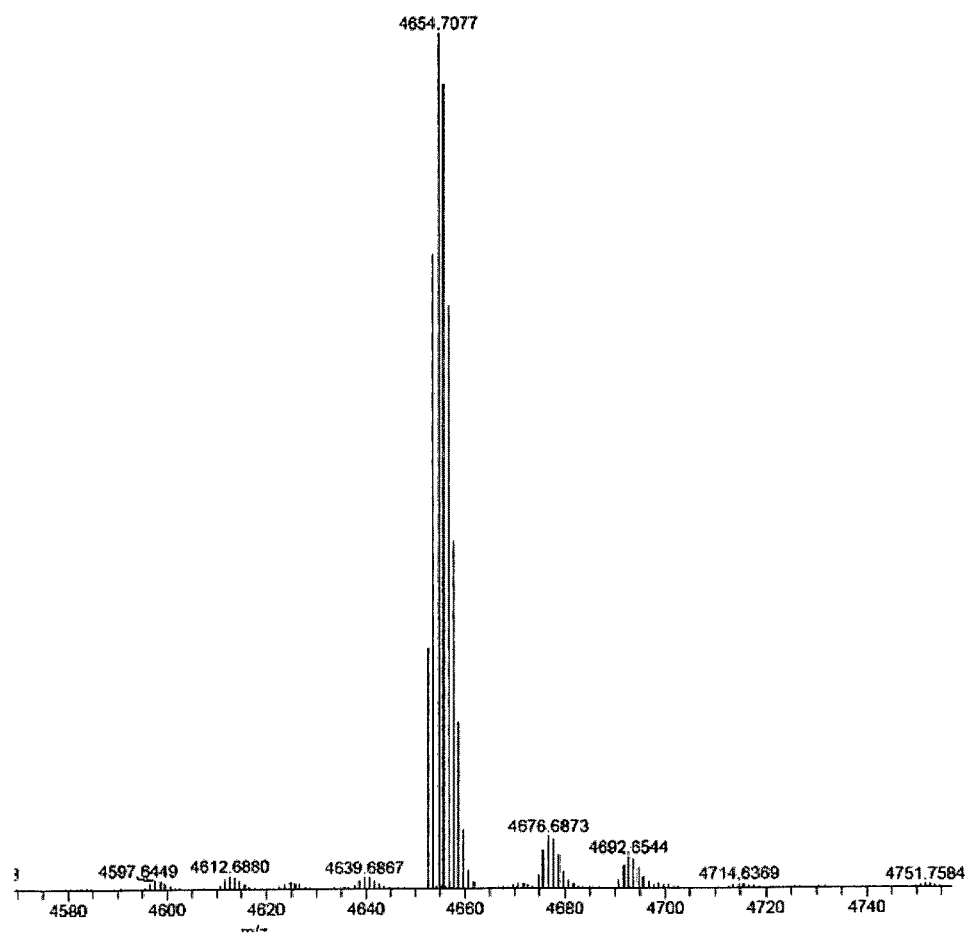
Fig. 2

(A)
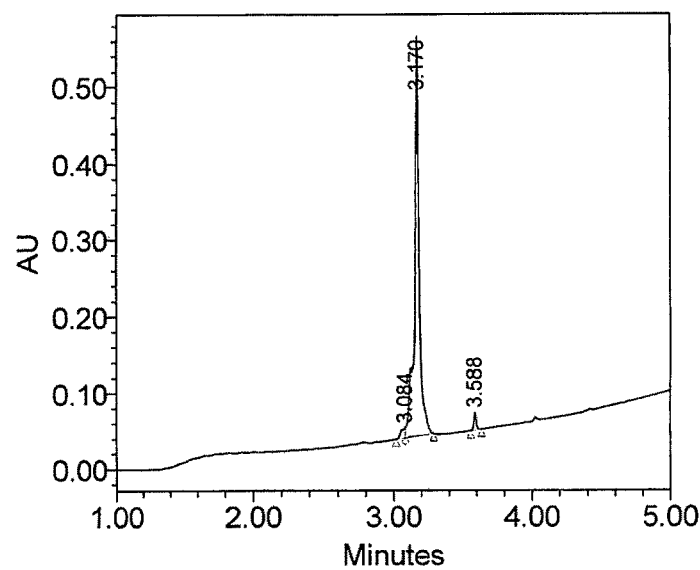
(B)
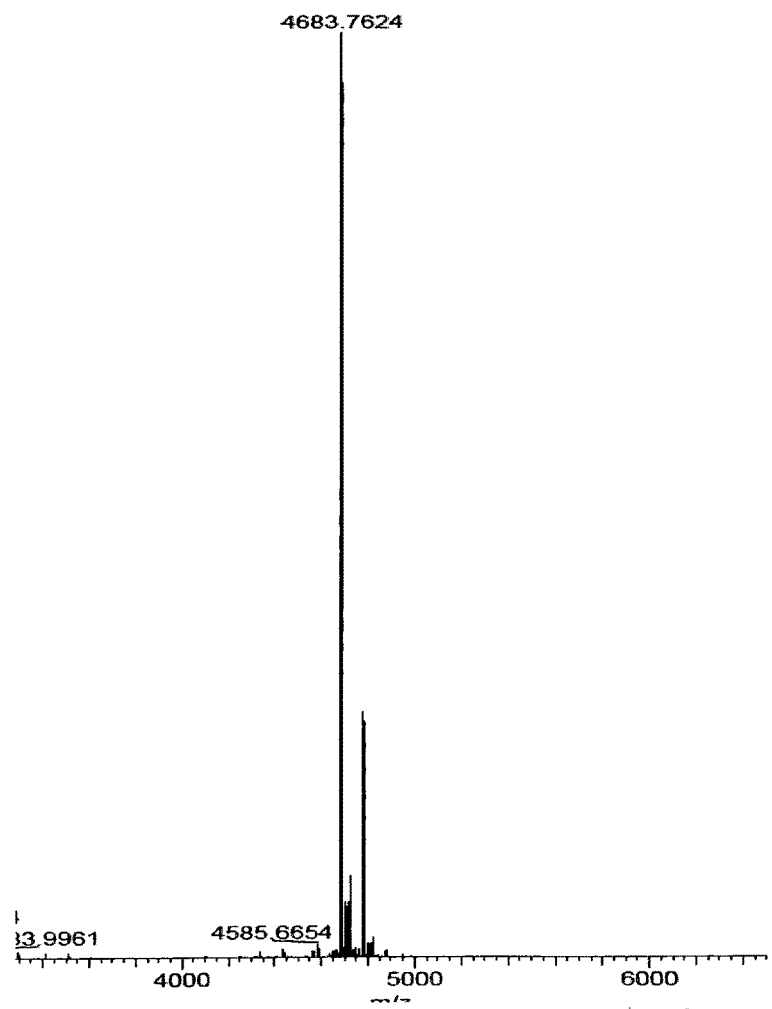
Fig. 3

(A)
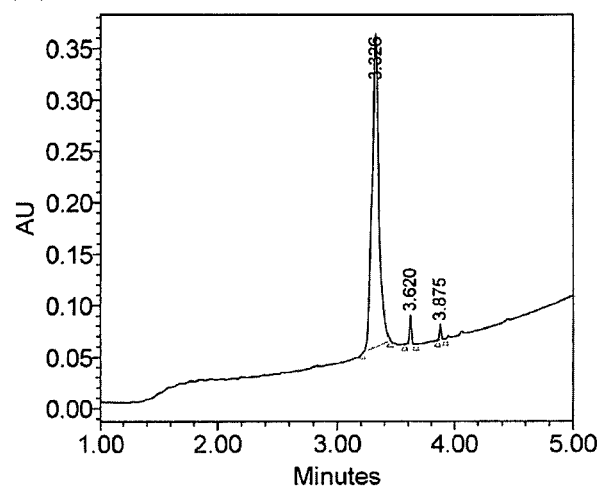
(B)
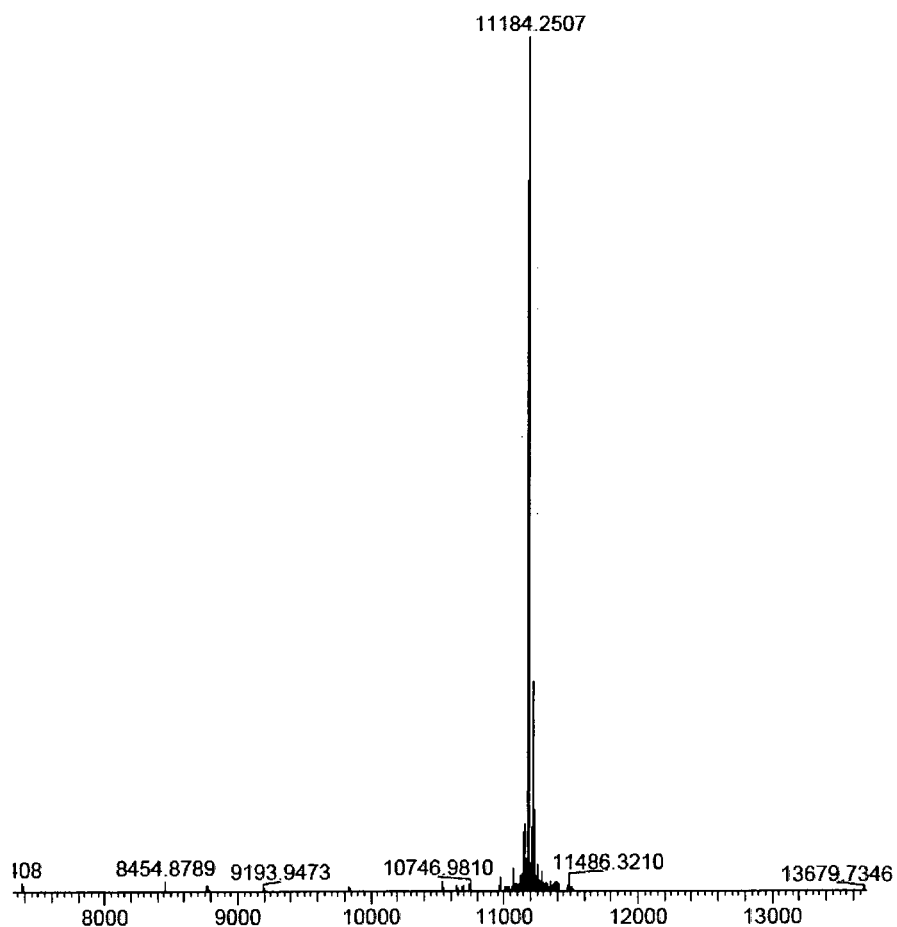
Fig. 4

(A)
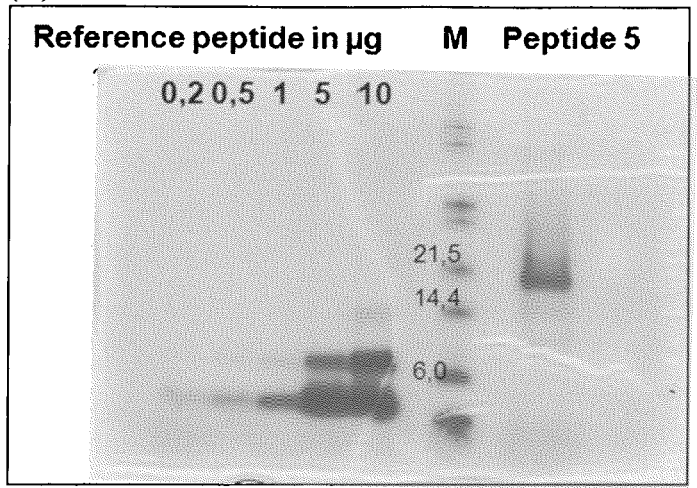
(B)
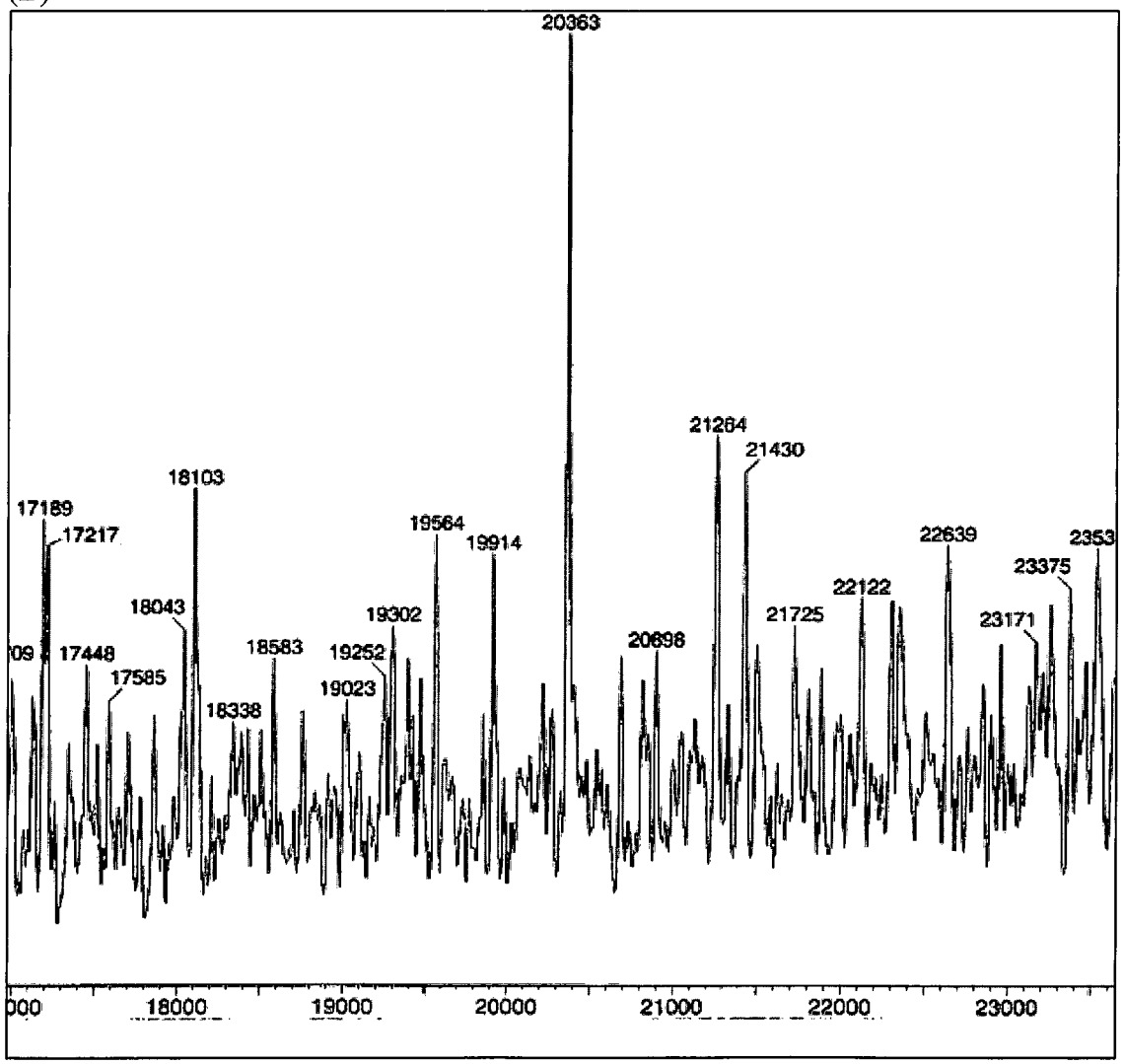
Fig. 6

```
                        MJ_1_58_MD (17-mer)  MJ_1_143_LD (17-mer)
Complex 1-gap-A (L) 5'-GG-GATCACAGTGAGTAC GTAAAACGACGGCCAGT-3'
                    3'-   CTAGTGTCACTCATGACATTTTGCTGCCGGTCA-5'
                                 MJ_1_145_LD (33-mer)

MJ_1_58_MD (17-mer)  MJ_1_143_LD (17-mer)
Complex 1-gap-C (L) 5'-GG-GATCACAGTGAGTAC GTAAAACGACGGCCAGT-3'
                    3'-   CTAGTGTCACTCATGCCATTTTGCTGCCGGTCA-5'
                                 MJ_1_146_LD (33-mer)

MJ_1_58_MD (17-mer)  MJ_1_143_LD (17-mer)
Complex 1-gap-G (L) 5'-GG-GATCACAGTGAGTAC GTAAAACGACGGCCAGT-3'
                    3'-   CTAGTGTCACTCATGGCATTTTGCTGCCGGTCA-5'
                                 MJ_1_147_LD (33-mer)

MJ_1_58_MD (17-mer)  MJ_1_143_LD (17-mer)
Complex 1-gap-T (L) 5'-GG-GATCACAGTGAGTAC GTAAAACGACGGCCAGT-3'
                    3'-   CTAGTGTCACTCATGTCATTTTGCTGCCGGTCA-5'
                                 MJ_1_144_LD (33-mer)
```

List of oligonucleotides for the 1-gap substrates:

| Name | nt | Configuration | Sequence (5'→3') |
|---|---|---|---|
| MJ_1_58_MD | 17 | first two G's = D, remainder = L | GG-GATCACAGTGAGTAC (SEQ ID NO:6) |
| MJ_1_143_LD | 17 | L | Phosphate-GTAAAACGACGGCCAGT (SEQ ID NO:7) |
| MJ_1_145_LD | 33 | L | ACTGGCCGTCGTTTTAC*A*GTACTCACTGTGATC (SEQ ID NO:8) |
| MJ_1_146_LD | 33 | L | ACTGGCCGTCGTTTTAC*C*GTACTCACTGTGATC (SEQ ID NO:9) |
| MJ_1_147_LD | 33 | L | ACTGGCCGTCGTTTTAC*G*GTACTCACTGTGATC (SEQ ID NO:10) |
| MJ_1_144_LD | 33 | L | ACTGGCCGTCGTTTTAC*T*GTACTCACTGTGATC (SEQ ID NO:11) |

```
                        MJ_1_58_MD (17-mer)        MJ_1_59_LD (12-mer)
Complex 6-gap (L):   5'-GG-GATCACAGTGAGTAC        ACGACGGCCAGT-3'
                     3'-   CTAGTGTCACTCATGTTATCTTGCTGCCGGTCA-5'
                                    MJ_1_57_LD (33-mer)
```

List of oligonucleotides for the 6-gap substrates:

| Name | nt | Configuration | Sequence (5'→3') |
|---|---|---|---|
| MJ_1_58_MD | 17 | first two G's = D, remainder = L | GG-GATCACAGTGAGTAC (SEQ ID NO:12) |
| MJ_1_59_LD | 12 | L | Phosphate-ACGACGGCCAGT (SEQ ID NO:13) |
| MJ_1_57_LD | 33 | L | ACTGGCCGTCGTTCTATTGTACTCACTGTGATC (SEQ ID NO:14) |

(B)

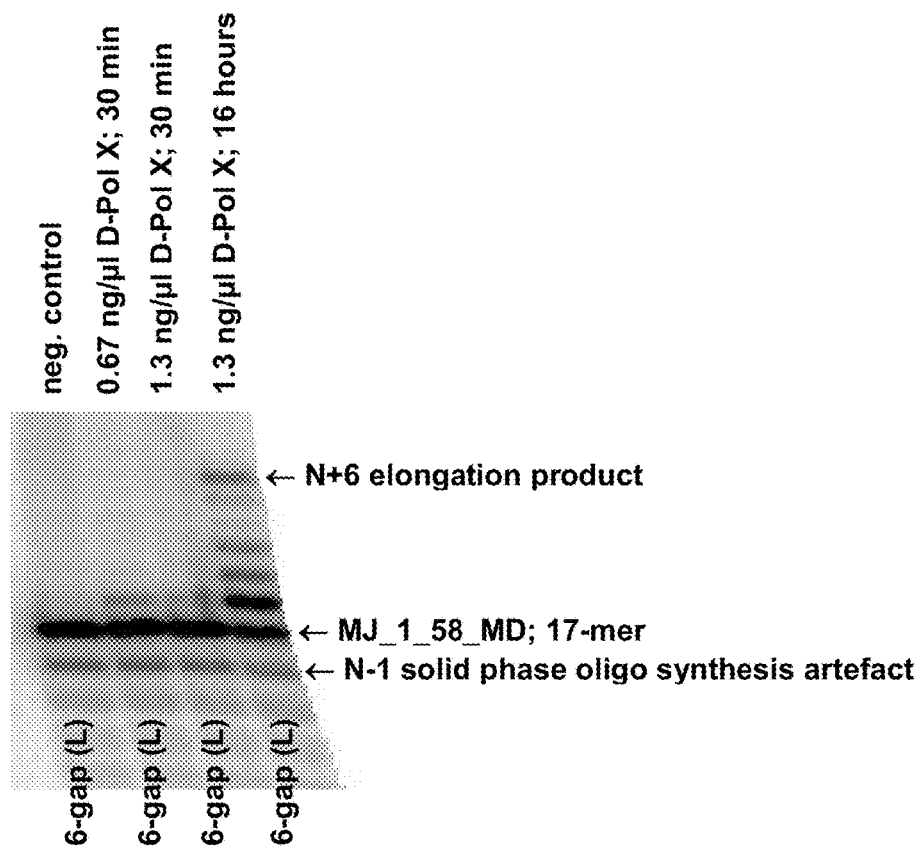

Atto532---MJ_1_33_DD_19nt

MJ_1_1_DD_83nt

(B)

1 2 3 4 5 6 7 8 9

1: negative control (no polymerase)
2: positive control (Taq)
3: wild-type L-Polymerase X, 1.7 ng/µl
4: L-Pol-X V80G, 1.7 ng/µl
5: L-Pol-X V80G, 4 ng/µl
6: L-Pol-X V80G, 4 ng/µl (unpurified)
7: L-Pol-X V80A, 1.7 ng/µl
8: L-Pol-X V80A, 4 ng/µl
9: L-Pol-X V80A, 4 ng/µl (unpurified)

(C)
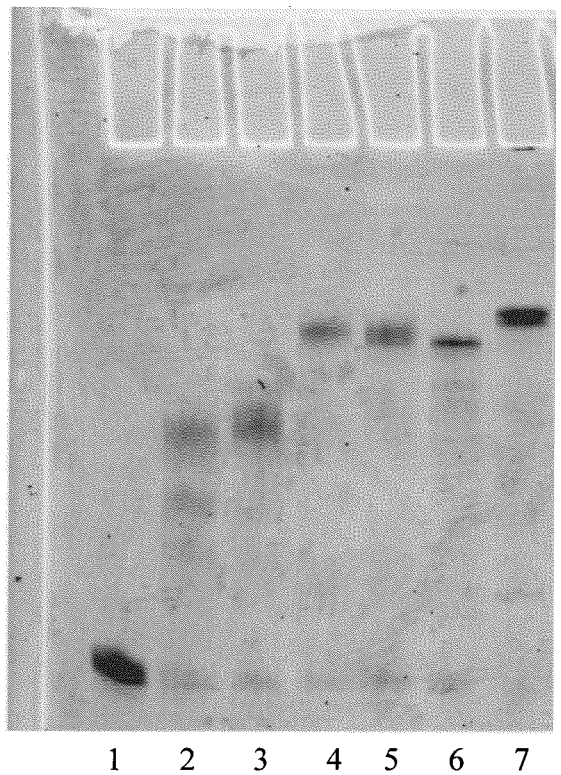
1: negative control (no polymerase)
2: wild-type L-Polymerase X, 5 thermal cycles
3: wild-type L-Polymerase X, 10 thermal cycles
4: wild-type L-Polymerase X, 15 thermal cycles
5: wild-type L-Polymerase X, 20 thermal cycles
6: wild-type L-Polymerase X, 25 thermal cycles
7: positive control (Taq)
Fig. 10 continuation (A)
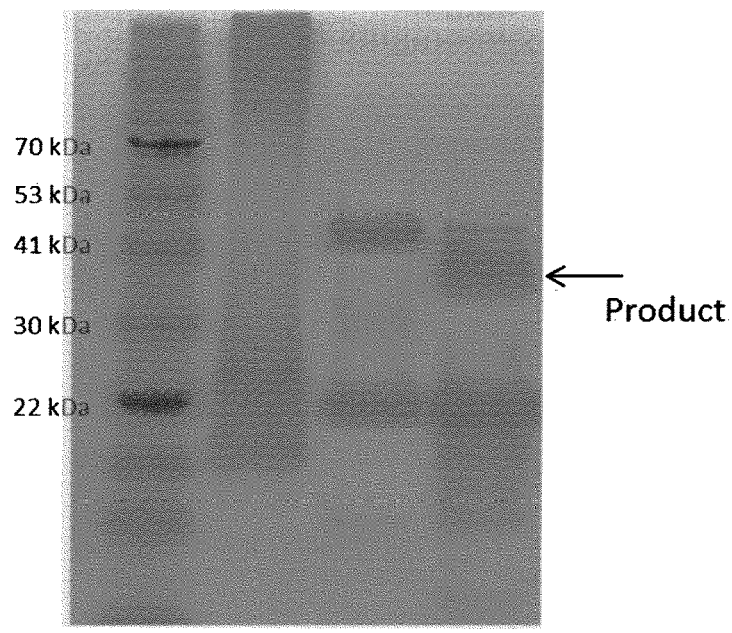
(B)
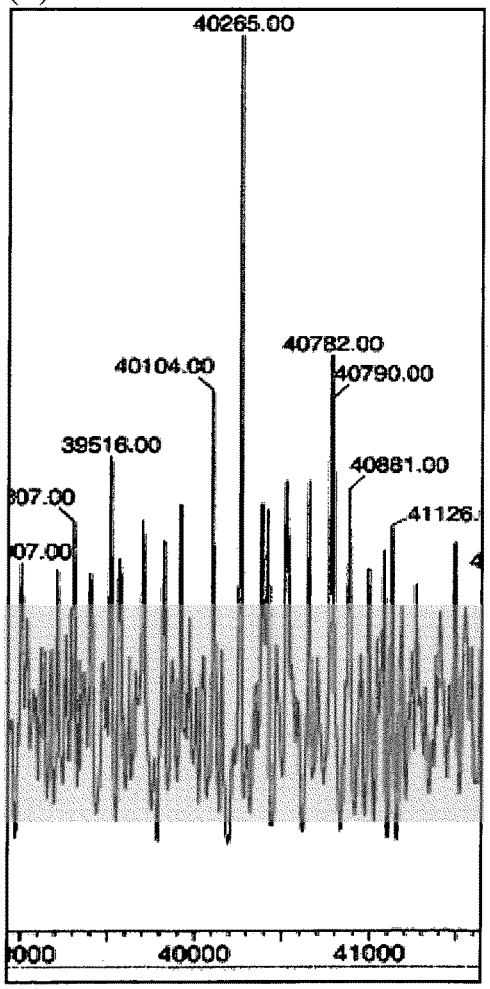
Fig. 11

(A)

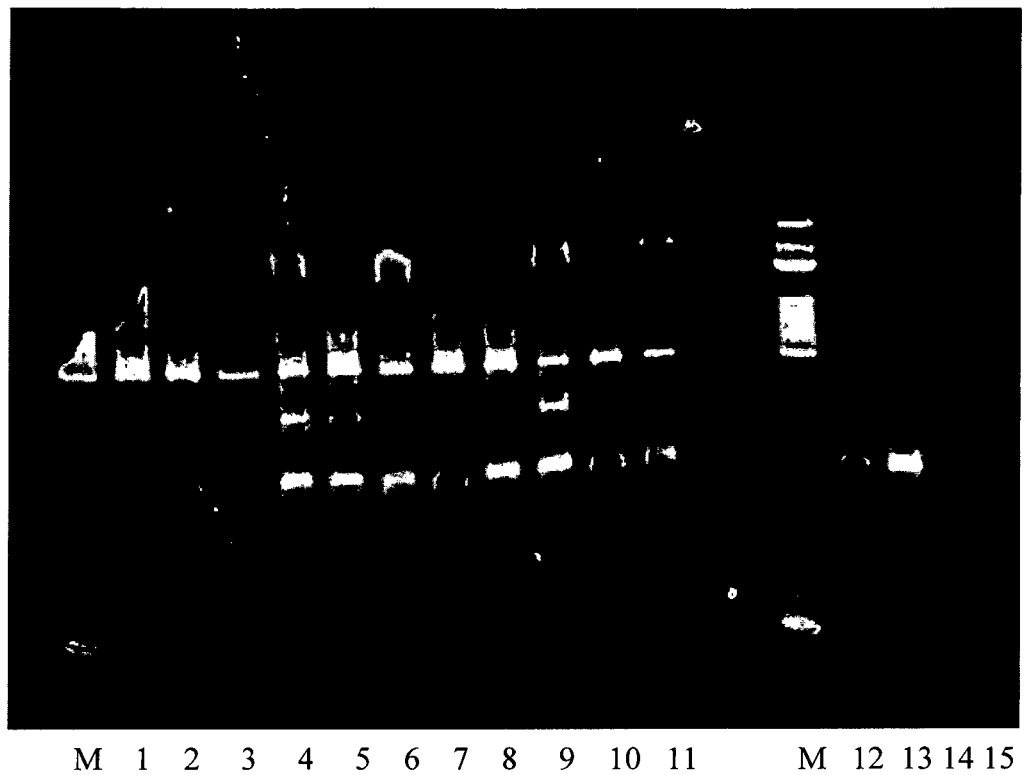

M   1   2   3   4   5   6   7   8   9   10  11      M   12  13 14 15

M: 10 bp DNA ladder (lowest visible band: 20 bp; 100 bp band more intense)
1: positive control, all-L-dpo4 from New England Biolabs (100 ng)
2: positive control, all-L-dpo4 from New England Biolabs (50 ng)
3: no sample loaded
4: all-L-polymerase dpo4 variant A155C (100 ng)
5: all-L-polymerase dpo4 variant A155C (50 ng)
6: all-L-polymerase dpo4 variant V203C (100 ng)
7: all-L-polymerase dpo4 variant V203C (50 ng)
8: all-L-polymerase dpo4 variant C31S (100 ng)
9: all-L-polymerase dpo4 variant C31S (50 ng)
10: all-L-polymerase dpo4 variant A155C/V203C (100 ng)
11: all-L-polymerase dpo4 variant A155C/V203C (50 ng)
12: negative control (template, fwd- and rev-primer)
13: fwd.-primer only
14: rev.-primer only
15: negative control (no template, no primers)

Fig. 12

(B)
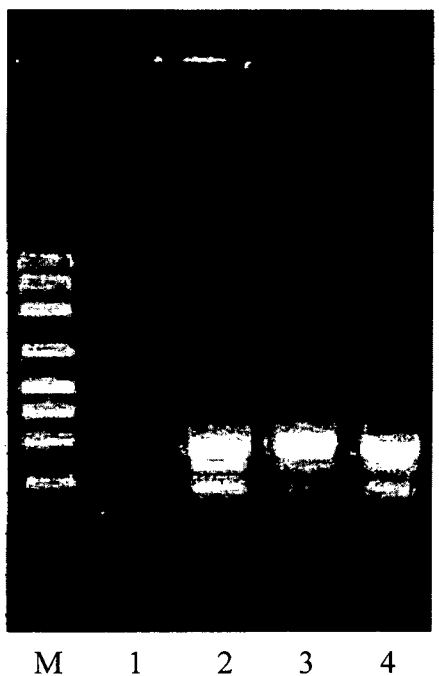
M   1   2   3   4
M: 50 bp DNA ladder (lowest band: 50 bp, then 100 bp)
1: negative control (without polymerase)
2: positive control; all-L-polymerase dpo4 (recombinant), 10 ng
3: all-L-polymerase dpo4 (synthetic), 10 ng
4: all-L-polymerase dpo4 (synthetic), 20 ng
Fig. 12 continuation

(C)
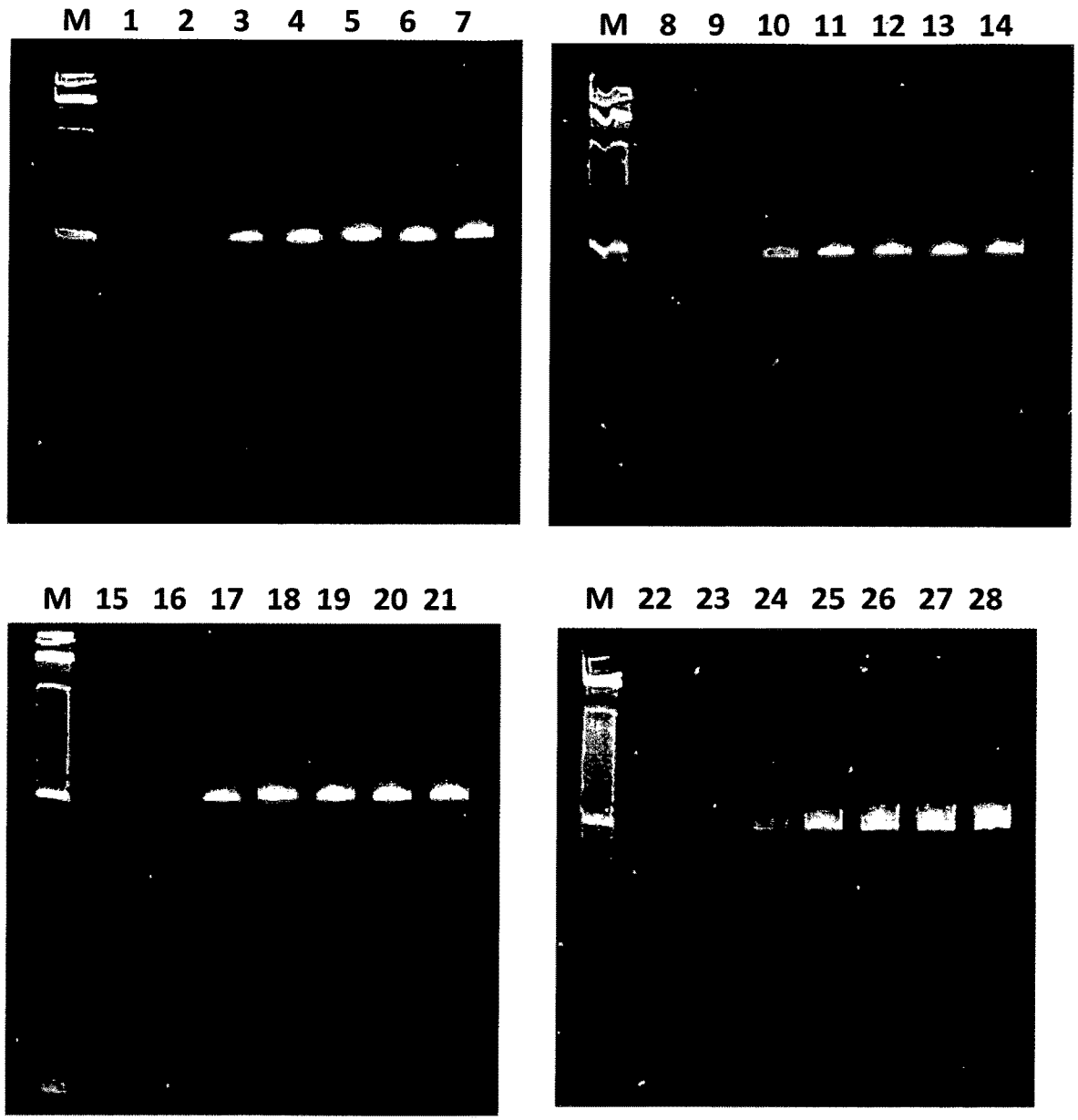
M: 10 bp DNA ladder (lowest intense band is 100 bp)
From all PCR reactions, samples were analyzed after 0, 5, 10, 15, 20, 25, 30 cycles.
lanes 1-7: positive control; all-L-polymerase dpo4 (recombinant)
lanes 8-14: dpo4 variant A71C/A155C/V203C
lanes 15-21: dpo4 variant S86C/A155C/V203C
lanes 22-28: dpo4 variant C31S/S86C/A155C/V203C
Fig. 12 continuation (D)
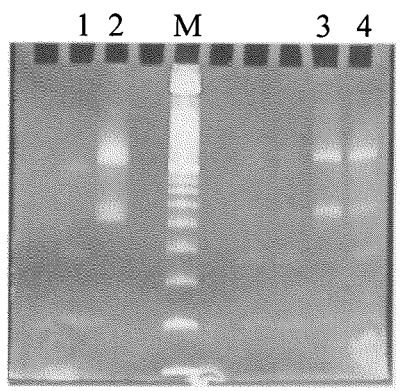
M: 10 bp DNA ladder (lowest visible band: 20 bp; 100 bp band more intense)
1: no enzyme control
2: positive control; all-L-polymerase dpo4 (recombinant)
3: dpo4 variant M76G/A155C/V203C
4: dpo4 variant M76A/A155C/V203C
Fig. 12 continuation

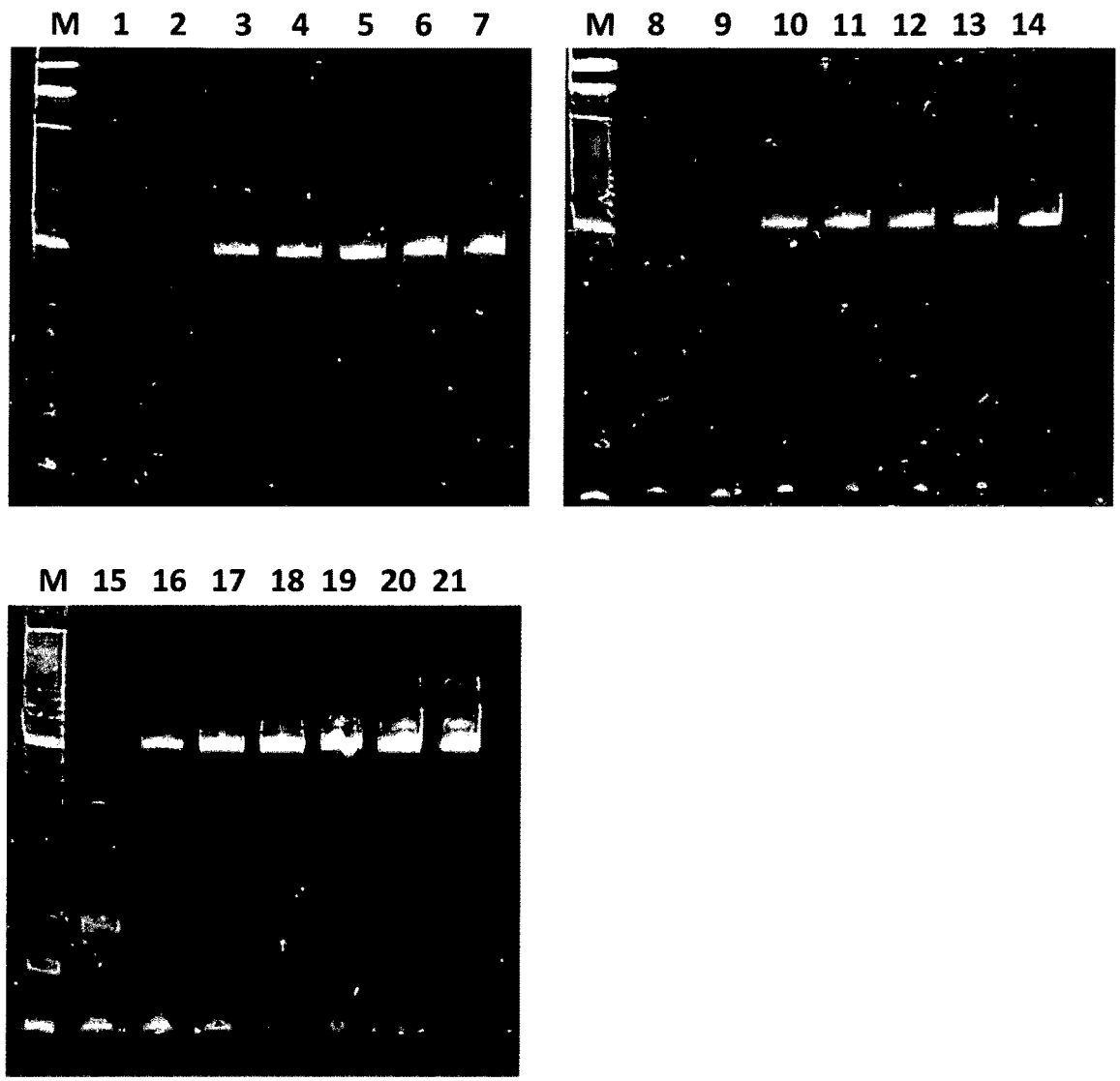
M: 10 bp DNA ladder (intense band is 100 bp)
From all PCR reactions, samples were analyzed after 0, 5, 10, 15, 20, 25, 30 cycles.
lanes 1-7: dpo4 variant I67C/A155C/V203C
lanes 8-14: dpo4 variant S86G/A155C/V203C
lanes 15-21: dpo4 variant S96C/A155C/V203C
Fig. 12 continuation

(F)
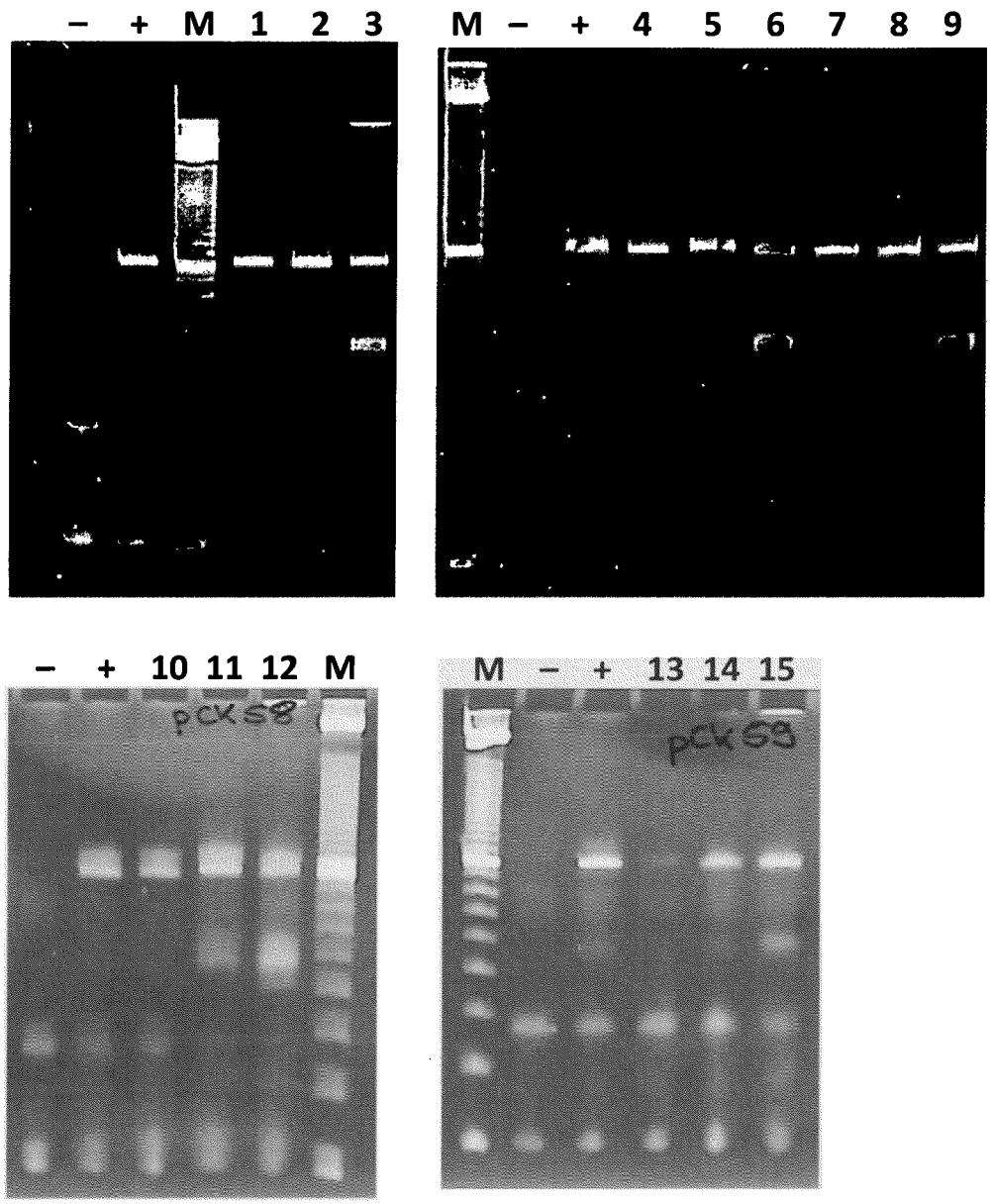
M: 10 bp DNA ladder (intense band is 100 bp)
−: no enzyme control
+: positive control; all-L-polymerase dpo4 (recombinant)
1-3: dpo4 truncated form Δ3 (0.333; 3.33; 16.67 ng/μl final in PCR)
4-6: dpo4 truncated form Δ6 (0.333; 3.33; 16.67 ng/μl final in PCR)
7-9: dpo4 truncated form Δ9 (0.333; 3.33; 16.67 ng/μl final in PCR)
10-12: dpo4 truncated form Δ12 (0.333; 3.33; 16.67 ng/μl final in PCR)
13-15: dpo4 truncated form Δ15 (0.333; 3.33; 16.67 ng/μl final in PCR)
Fig. 12 continuation (A)
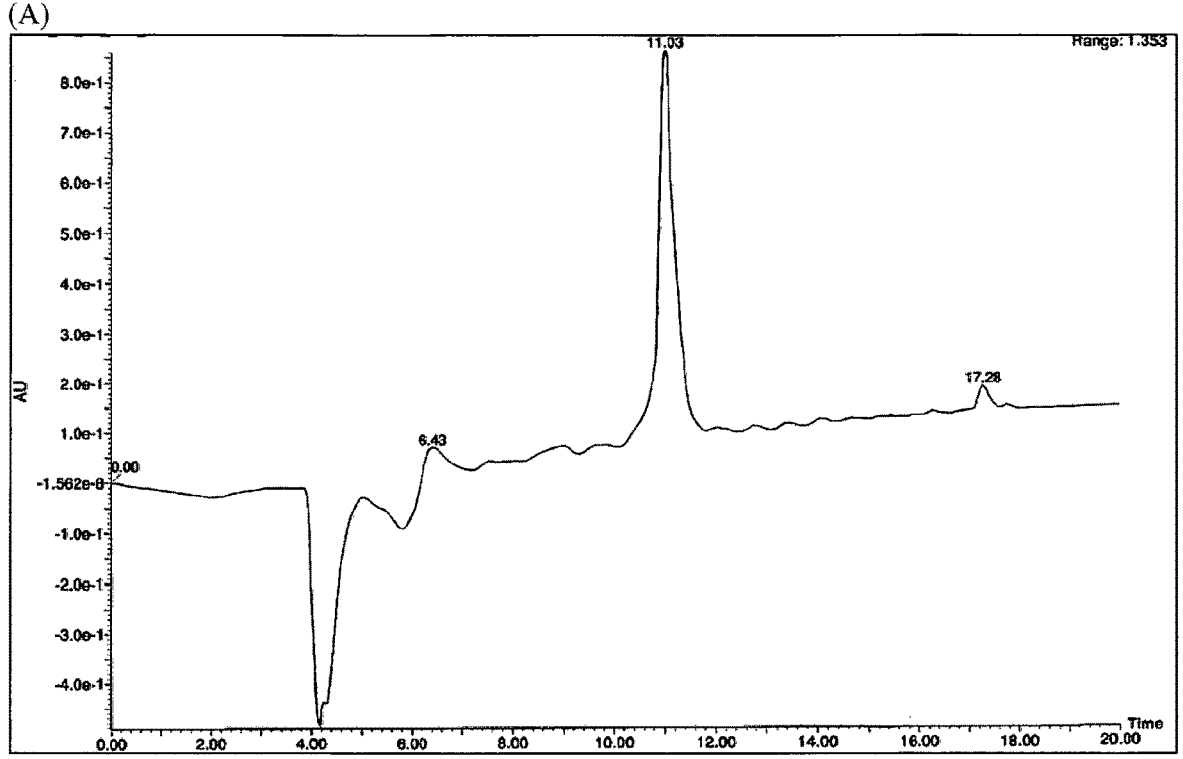
(B)
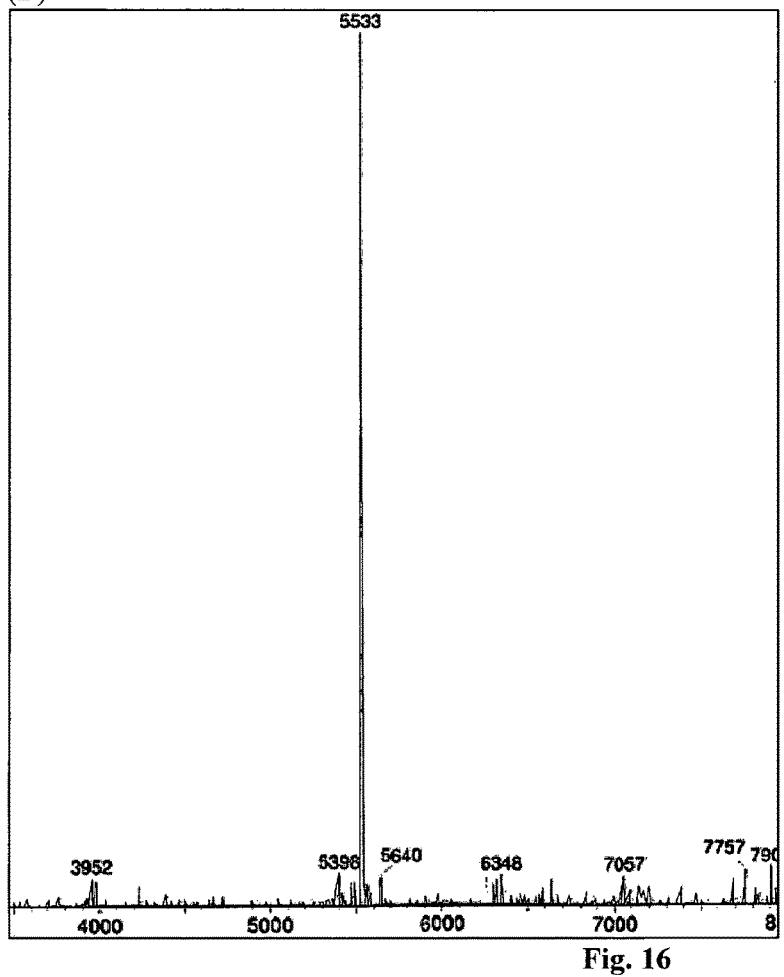
Fig. 16

(A)
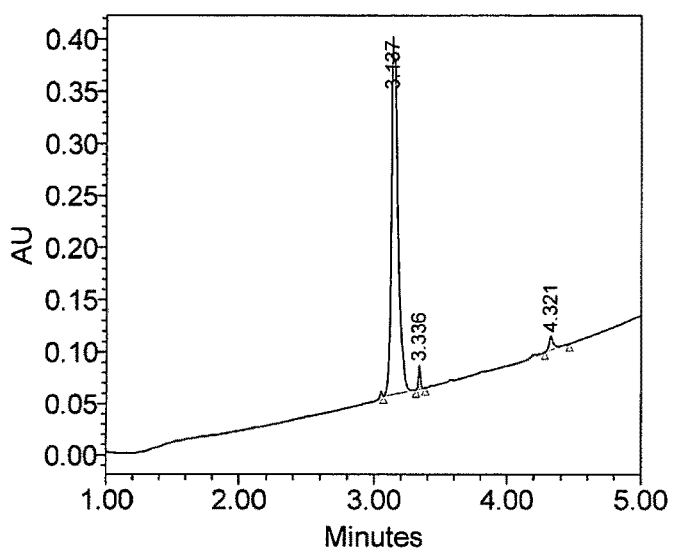
(B)
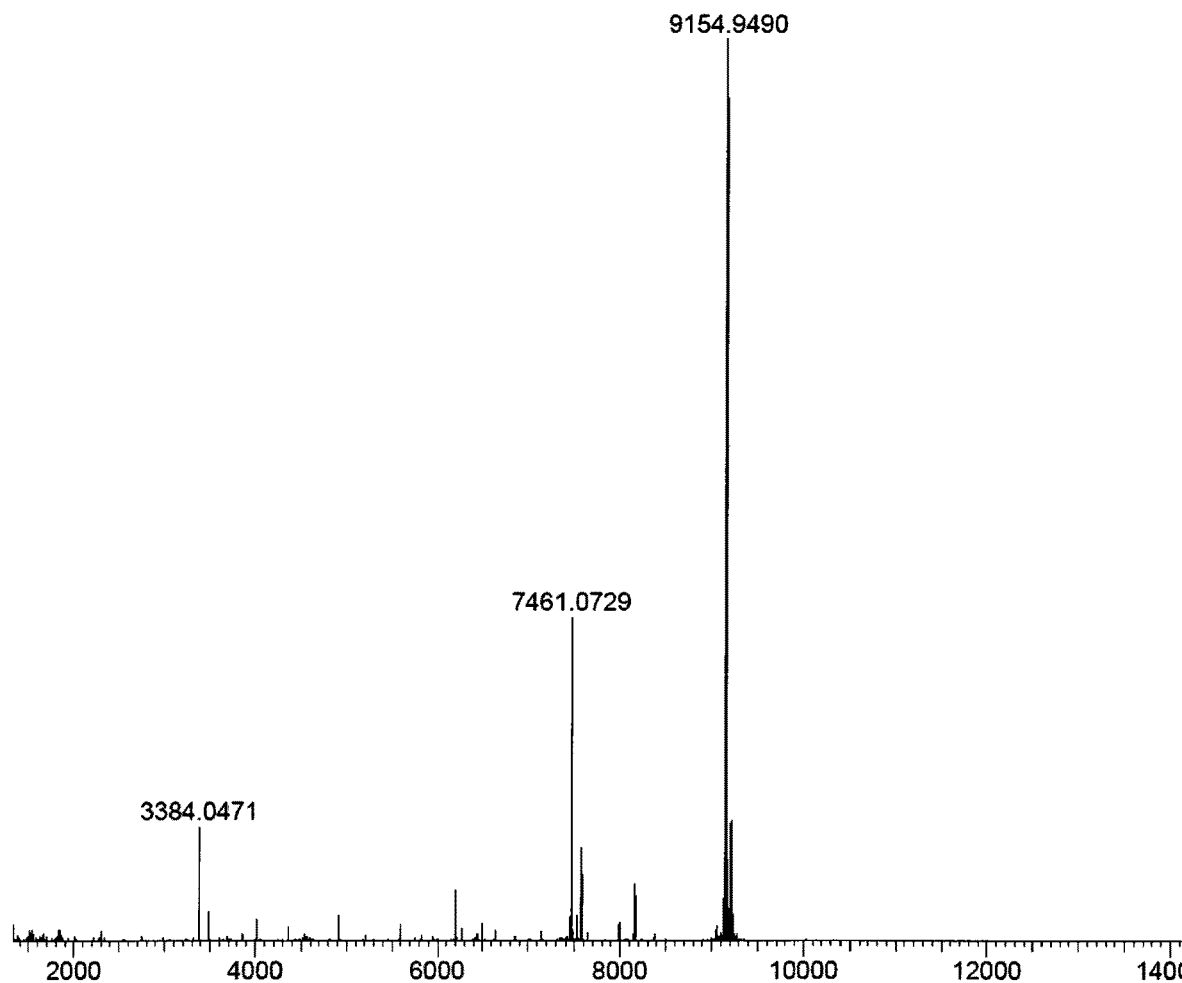
Fig. 17

(A)
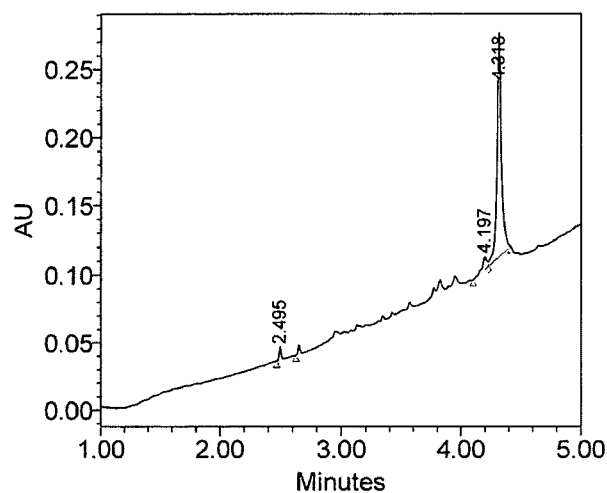
(B)
Fig. 18

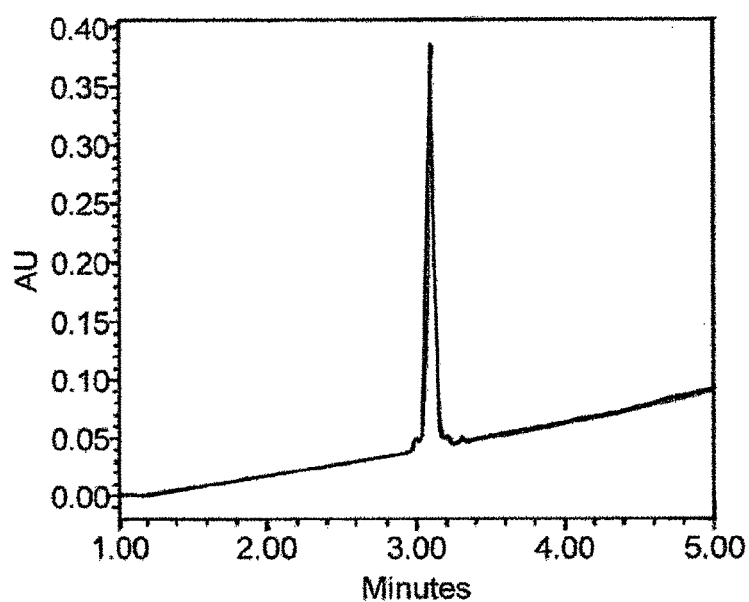
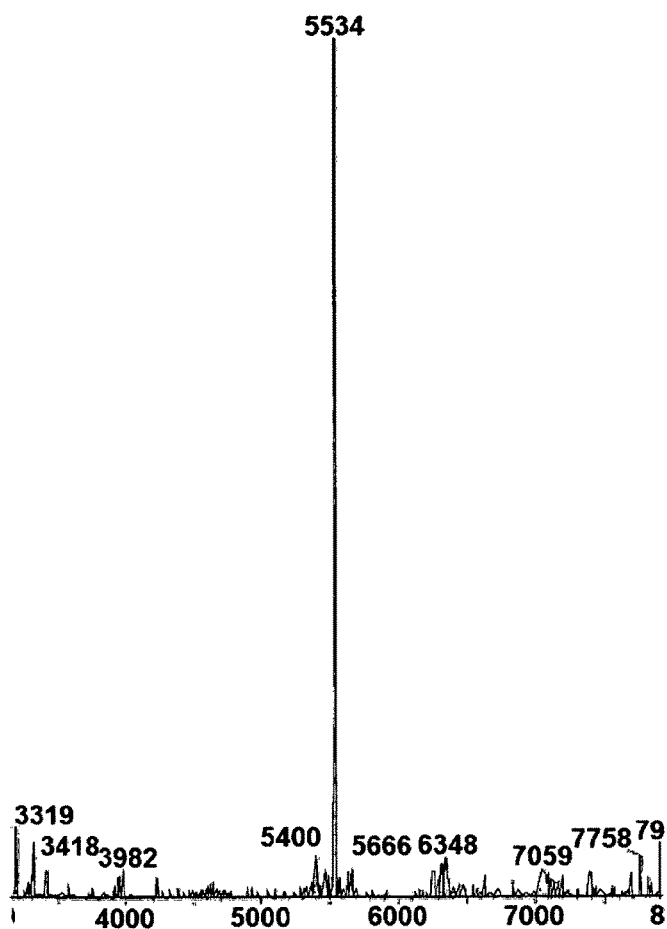
Fig. 25

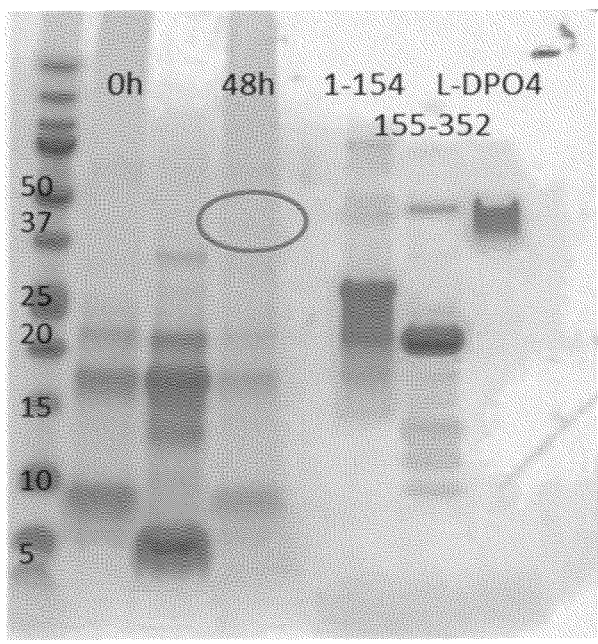
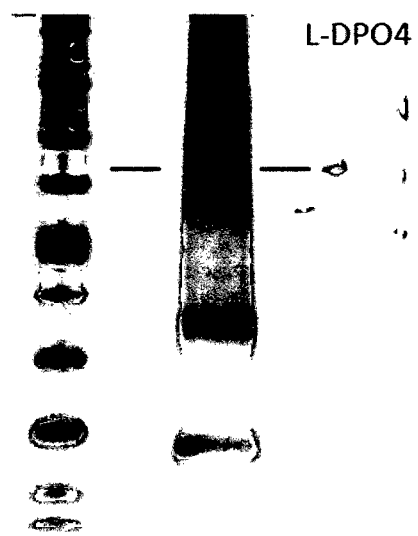
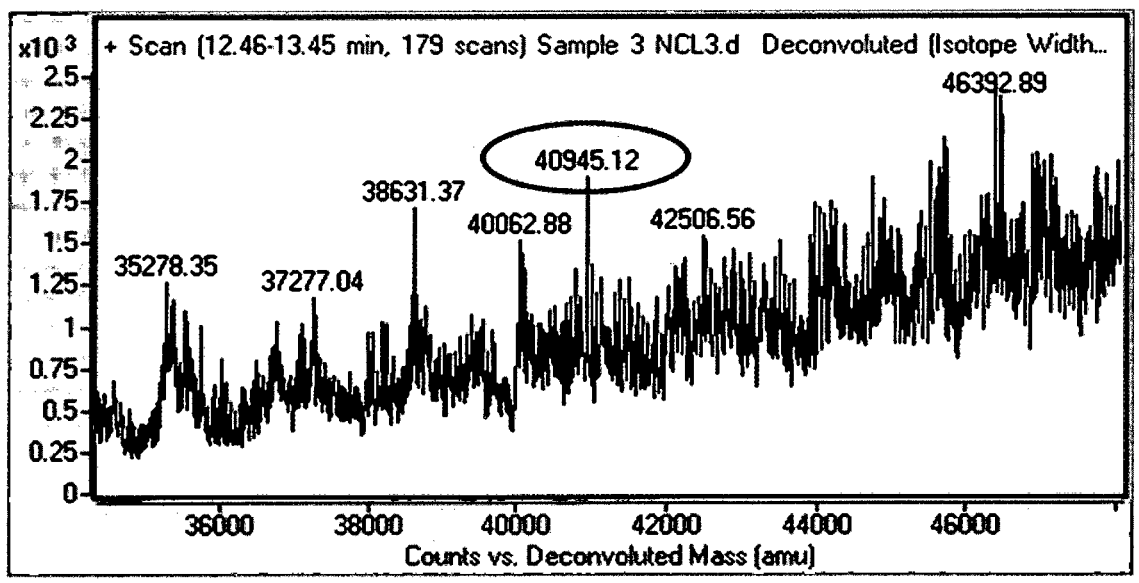
Fig. 28

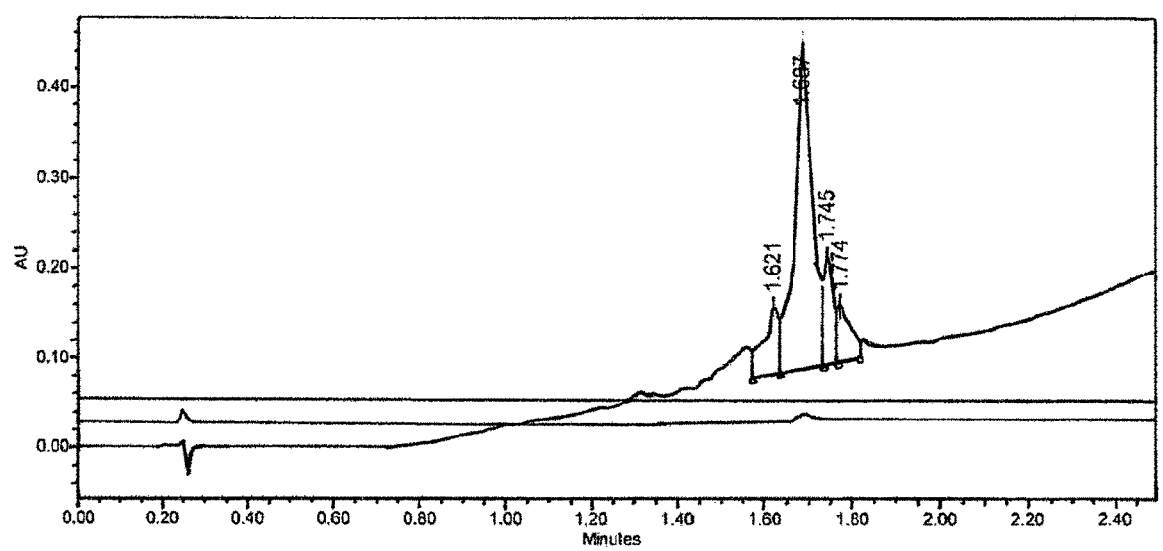
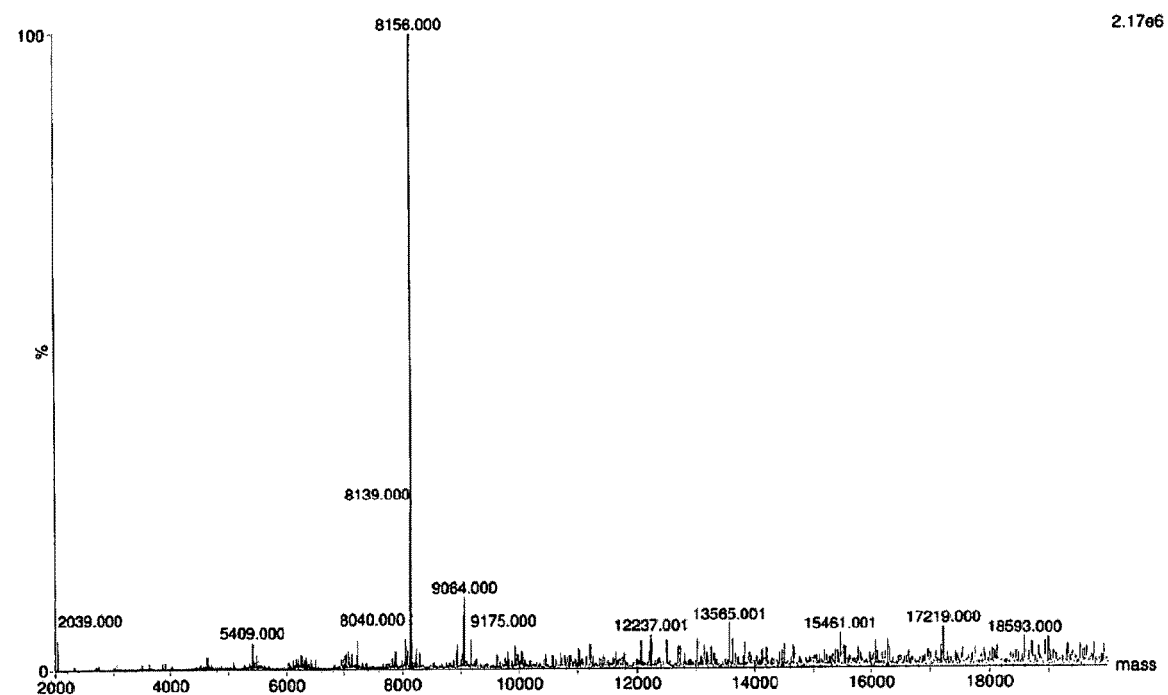
Fig. 34

(A)
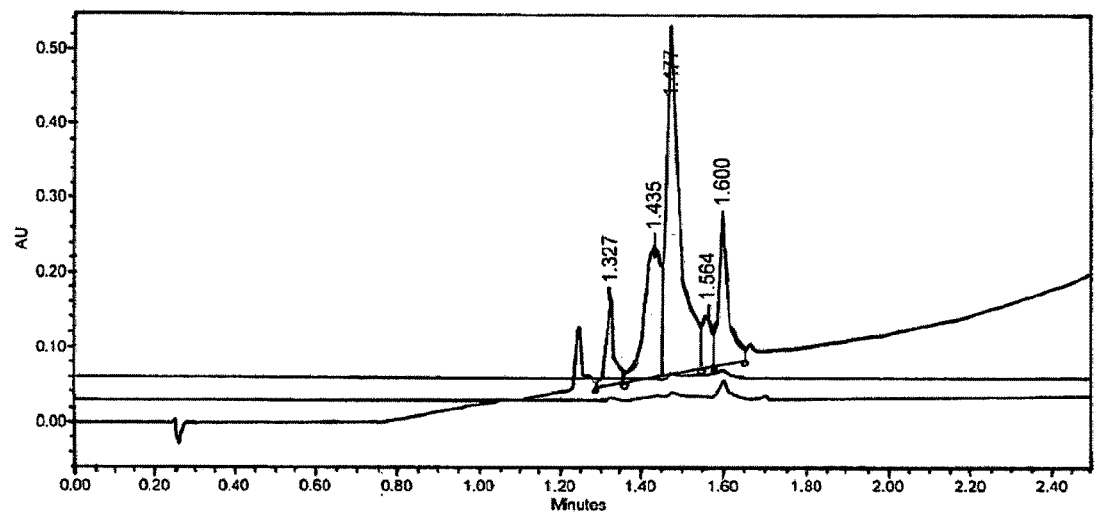
(B)
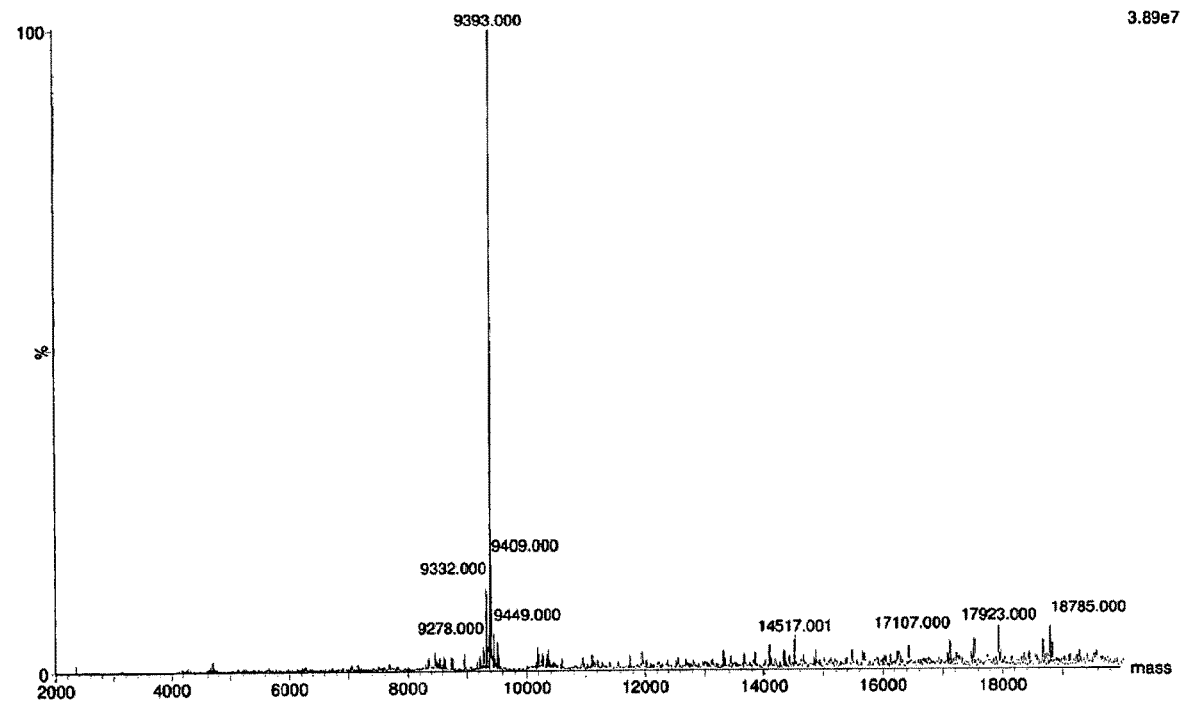
Fig. 35

(A)
(B)
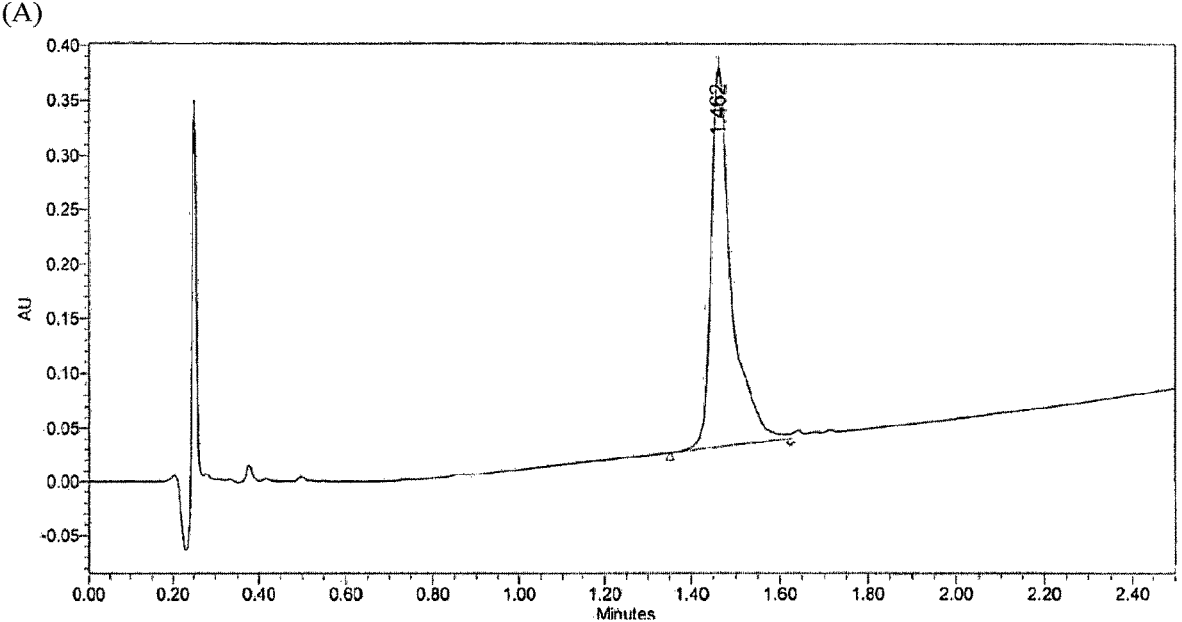
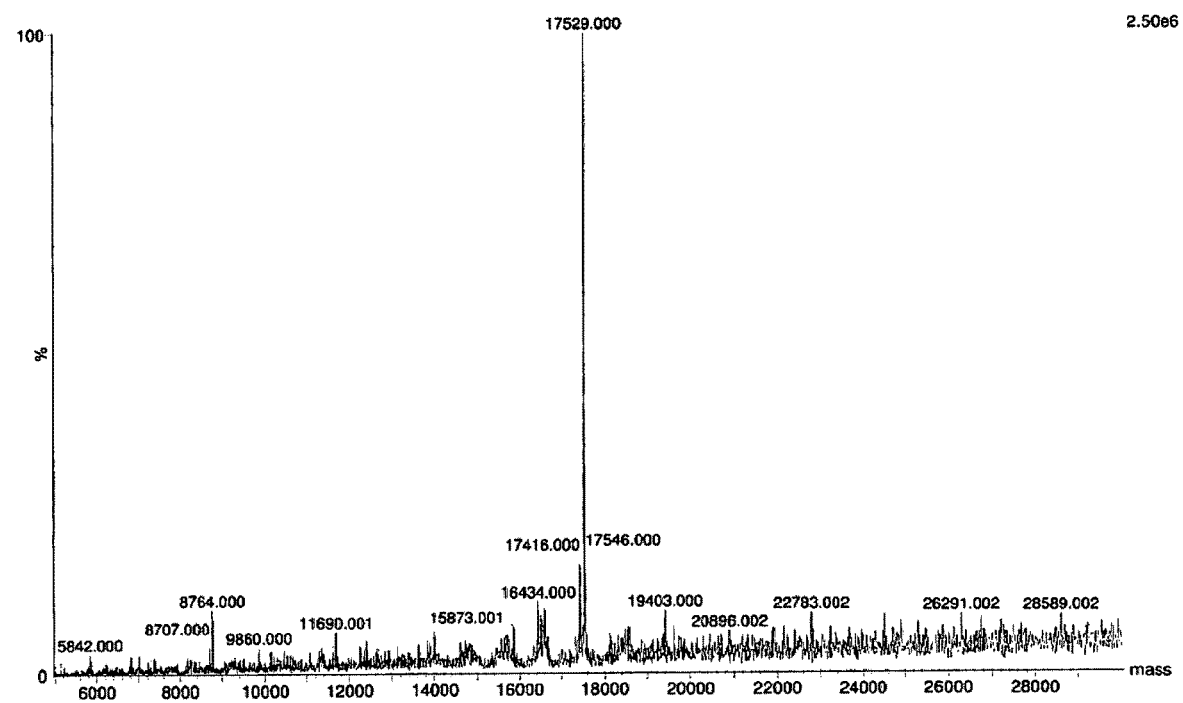
Fig. 36

(A)
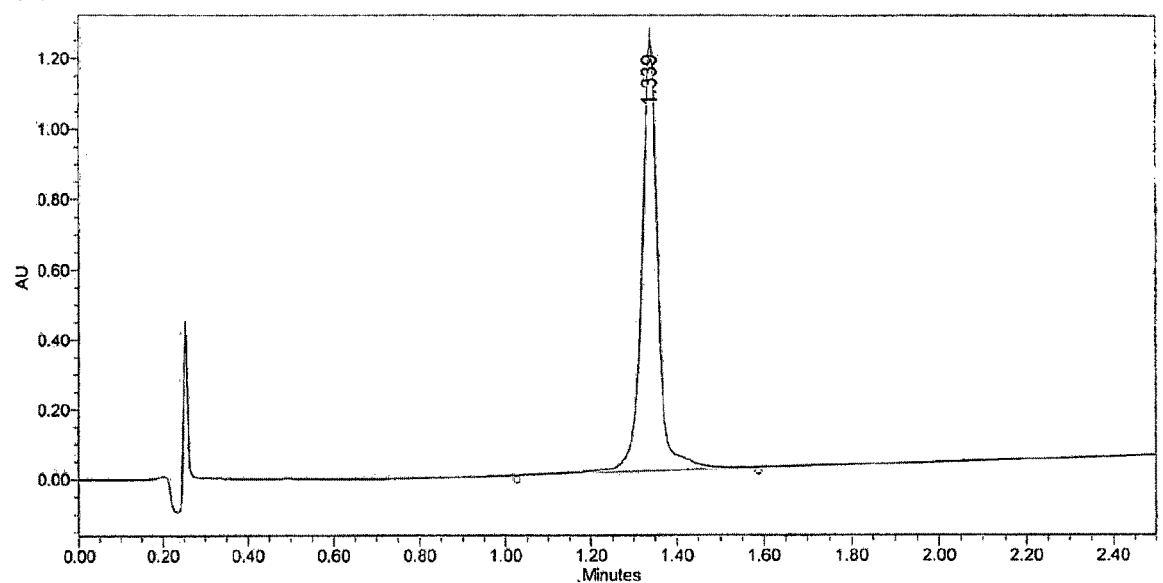
(B)
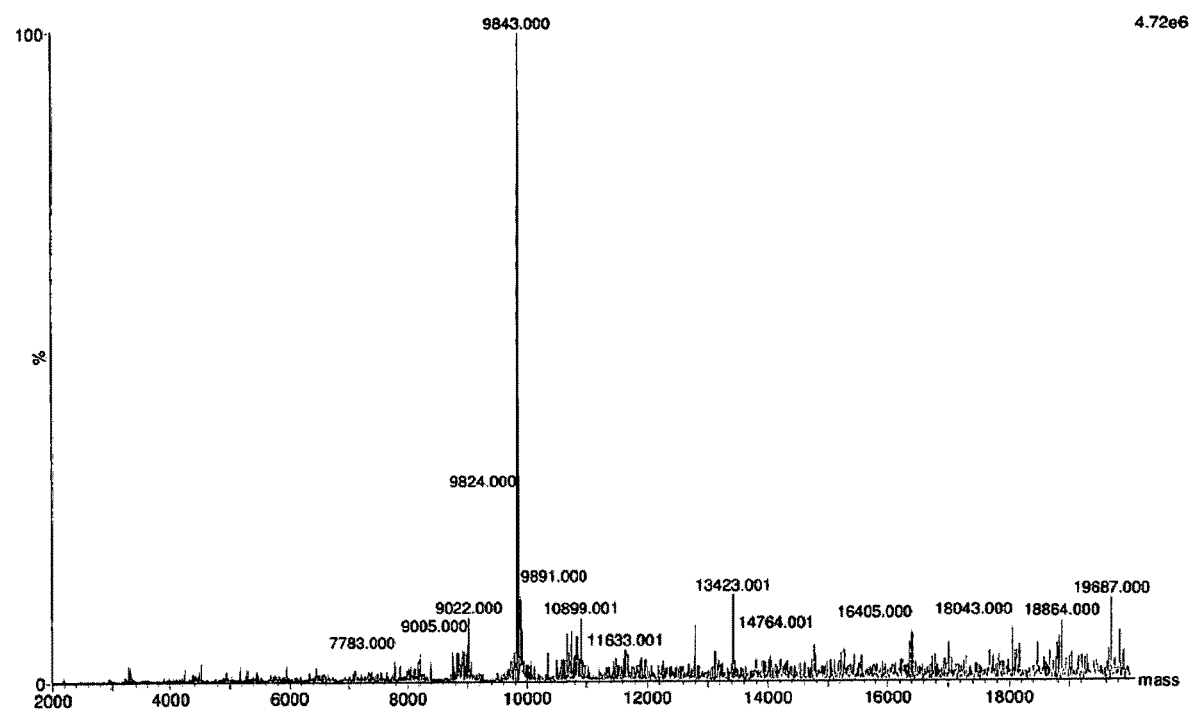
Fig. 37

US 11,634,741 B2

SYNTHESIS OF L-NUCLEIC ACIDS BY MEANS OF AN ENZYME

The present invention is related to a method for adding one or more L-nucleotides to the 3' end of a first L-nucleic acid, a method for amplifying a target L-nucleic acid, a protein comprising an enzymatic activity exhibiting moiety, polymerases comprising an amino acid sequence wherein the amino acid of the amino acid sequence are D-amino acids, a polymerase variant of a wild type polymerase, wherein the wild type polymerase consists of an amino acid sequence according to SEQ ID NO: 15, use of a protein comprising an enzymatic activity exhibiting moiety in a method for adding one or more L-nucleotides, use of a protein comprising an enzymatic activity exhibiting moiety in a method for amplifying a target L-nucleic acid, a method for the identification of a target molecule binding L-nucleic acid molecule, and a method for producing the protein and polymerase, respectively.

The availability of gene technology in the broader sense contributed much to the progress made over the last decades in the fields of medicine and diagnosis as well as in basic research. Synthesis power provided by gene technology is going beyond the one of chemical synthesis. Gene technology and genetic engineering in particular allow the production of factually unlimited amounts of L-peptides and L-proteins making use of the enzymatic machinery of prokaryotic and eukaryotic cells. Enzymes and polymerases in particular, either wild type forms or variants of such wild type forms, allow the synthesis of D-nucleic acids linking the building blocks of such D-nucleic acids, i.e. D-nucleotides to a length which is, at least not with a reasonable yield, achievable by chemical synthesis.

Due to chiral specificity, the enzymes used in gene technology can only make use of building blocks and substrates, respectively, the chirality of which fits to their own chirality. Buildings blocks and substrates, respectively, of opposite chirality cannot be subject to the enzymes' activity. Due to the principle of chiral reciprocity, the processing of building blocks and substrates, respectively, of opposite chirality require the enzymes to have opposite chirality, too.

This principle of chiral reciprocity is, for example, intensively used in the generation of target binding L-nucleic acids which are also known and referred to as spiegelmers. To date spiegelmers are identified by a process that uses, in a first step, a D-nucleic acid library for in vitro selection against the enantiomeric form of the target molecule or target structure such as D-peptides or D-proteins. In a second step, the thus identified D-nucleic acids binding to the enantiomeric form of the target molecule or target structure are prepared as corresponding L-nucleic acids. As a result of the principle of chiral reciprocity these L-nucleic acids, i.e. spiegelmers, are able to bind to the true or actual target molecule such as L-peptides or L-proteins and not to the enantiomeric form thereof such as D-peptides or D-proteins used for the selection process. Preferably, such true or actual target molecule or target structure is the target molecule or target structure as present in a biological system such as a human or animal body. Methods for the preparation of such spiegelmers are described, for example, in described in 'The Aptamer Handbook' (eds. Klussmann, 2006).

One way of making the process of identifying spiegelmers easier, could be to redesign the process such that L-nucleic acids are directly selected from a L-nucleic acid library using the target molecule or target structure in that enantiomeric form exhibited by the true or actual target molecule or target structure. As part of the process is the amplification of those L-nucleic acids initially binding to the target molecule and target structure, respectively, a polymerase adding at least one nucleotide to an L-primer would be required. To date, no polymerase consisting of L-amino acids is known which is capable of doing so. Because of this, there is a need for a polymerase and similar enzymes consisting of D-amino acids. As gene technology cannot provide such functionally active polymerase consisting of D-amino acids, chemical synthesis is required. However, the synthesis of D-proteins or D-polypeptides is limited to comparatively small molecules. The largest D-protein synthesized so far is the D-protein form of the angiogenic protein vascular endothelial growth factor (abbr. VEGF-A) consisting of 102 D-amino acids (Mandal et al., 2012), Polymerases, however, typically consist of more than 300 amino acids.

Therefore, the problem underlying the present invention is the provision of a method which allow the adding of at least one nucleotide to an L-nucleic acid such as a primer. A further problem underlying the present invention is the provision of a method for amplifying a target L-nucleic acid making use of L-nucleotides. A still further problem underlying the present invention is the provision of means which allow the practicing of such methods.

These and other problems underlying the present invention are solved by the subject matter of the attached independent claims. Preferred embodiments may be taken from the attached dependent claims.

More specifically, these and other problems underlying the present invention are also solved by the following embodiments.

Embodiment 1

A method for adding one or more L-nucleotides to the 3'end of a first L-nucleic acid, wherein the method comprises the step of reacting the one or more L-nucleotides with the first L-nucleic acid in the presence of a protein comprising a mutant enzymatic activity exhibiting moiety, wherein the enzymatic activity is capable of adding one or more L-nucleotides to the 3' end of the first L-nucleic acid,
wherein the mutant enzymatic activity exhibiting moiety comprises an amino acid sequence, wherein the amino acids of the amino acid sequence are D-amino acids,
wherein the mutant enzymatic activity exhibiting moiety is a variant of an enzymatic activity exhibiting moiety, wherein the enzymatic activity exhibiting moiety consists of an amino acid sequence according to SEQ ID NO: 15 and wherein the amino acids of the amino acid sequence according to SEQ ID NO: 15 are D-amino acids,
wherein the amino acid sequence of the mutant enzymatic activity exhibiting moiety differs from the amino acid sequence of the enzymatic activity exhibiting moiety consisting of an amino acid sequence according to SEQ ID NO: 15 at least at one amino acid position, preferably at three amino acid positions, and/or
wherein the amino acid sequence of the mutant enzymatic activity exhibiting moiety is a truncated form of an amino acid sequence according to SEQ ID NO: 15, and
wherein the amino acid sequence of the mutant enzymatic activity exhibiting moiety is different from an amino acid sequence according to any of SEQ ID NOs 15 to 22 and 51.

Embodiment 2

The method according to embodiment 1, wherein the amino acid sequence of the mutant enzymatic activity exhibiting moiety differs from the amino acid sequence of the enzymatic activity exhibiting moiety consisting of an amino acid sequence according to SEQ ID NO: 15 at the following amino acid position(s) of the amino acid sequence according to SEQ ID NO: 15 or at amino acid position(s) corresponding thereto:
a) at least one of amino acid positions 71, 76, 67, or 86, or
b) amino acid position 155 or 203 and 71; or
c) amino acid position 155 or 203 and 31; or
d) amino acid position 155 or 203 and 76; or
e) amino acid position 155 or 203 and 67; or
f) amino acid position 155 or 203 and 86; or
g) amino acid position 155 or 203 and 96, or
h) amino acid position 155 or 203 and 85, or
i) amino acid position 155 and 203 and 71, or
j) amino acid position 155 and 203 and 86, or
k) amino acid position 155 and 203 and 31, or
l) amino acid position 155 and 203 and 76, or
m) amino acid position 155 and 203 and 67, or
n) amino acid position 155 and 203 and 86, or
o) amino acid position 155 and 203 and 96, or
p) amino acid position 155 and 203 and 85,
wherein preferably in any one of a) to p) the amino acid at positions 155, 203, 71, 67, 85 and 96 are substituted by cysteine, the amino acid at position 31 is substituted by serine, the amino acid at position 76 is substituted by glycine or alanine, and the amino acid at position 86 is substituted by glycine or cysteine.

Embodiment 3

The method according to embodiment 2, wherein the mutant enzymatic activity exhibiting moiety comprises an amino acid sequence according to any one of SEQ ID NOs 89 to 120, preferably an amino acid sequence according to SEQ ID NO: 89 or an amino acid sequence according to SEQ ID NO: 90 or an amino acid sequence according to SEQ ID NO: 94 or an amino acid sequence according to SEQ ID NO: 97, more preferably an amino acid sequence according to SEQ ID NO: 94 or an amino acid sequence according to SEQ ID NO: 97, most preferably an amino acid sequence according to SEQ ID NO: 94.

Embodiment 4

The method according to embodiment 1, wherein the amino acid sequence of the mutant enzymatic activity exhibiting moiety is a truncated form of an amino acid sequence according to SEQ ID NO: 15, wherein the truncated form is lacking the n C-terminal amino acids of the amino acid sequence according to SEQ ID NO: 15, wherein n is any integer selected from the group comprising 1, 2, 3, 4, 5, 6, 7, 8, 9, 10, 11, 12, 13, 14, and 15.

Embodiment 5

The method according to any one of embodiments 1 and 4, wherein the mutant enzymatic activity exhibiting moiety comprises an amino acid sequence according to any one of SEQ ID NOs 121, 161, 201, 241 and 281.

Embodiment 6

The method according to any one of embodiments 1 and 4, wherein the mutant enzymatic activity exhibiting moiety comprises an amino acid sequence that differs from an amino acid sequence of a truncated form of an amino acid sequence according to SEQ ID NO: 15 at least at one amino acid position, preferably at three amino acid positions, wherein the truncated form of an amino acid sequence according to SEQ ID NO: 15 is an amino acid sequence according to any one of SEQ ID NOs: 121, 161, 201, 241 and 281

Embodiment 7

The method according to embodiment 6, wherein the amino acid sequence of the mutant enzymatic activity exhibiting moiety differs from the amino acid sequence of any one of SEQ ID NOs: 121, 161, 201, 241 and 281 at the following position(s) of the amino acid sequence according to any one of SEQ ID NOs: 121, 161, 201, 241 and 281 or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine, and the amino acid at position 86 is substituted by glycine or cysteine,
wherein more preferably the amino acid sequence of the mutant enzymatic activity exhibiting moiety comprises an amino acid sequence according to any one of SEQ ID NOs: 122 to 160, 162 to 200, 202 to 240, 242 to 280, and 282 to 338, wherein most preferably the amino acid sequence of the mutant enzymatic activity exhibiting moiety comprises an amino acid sequence according to any one of SEQ ID NOs 135, 174, 214, 254, 294.

Embodiment 8

The method according to embodiment 1, wherein the mutant enzymatic activity exhibiting moiety comprises an amino acid sequence according to any one of SEQ ID NOs: 339 to 343.

Embodiment 9

The method according to embodiment 1, wherein the mutant enzymatic activity exhibiting moiety comprises an amino acid sequence that differs from a mutant form of an amino acid sequence according to SEQ ID NO: 15 at least at one amino acid position, preferably at three amino acid positions, wherein the mutant form of an amino acid sequence according to SEQ ID NO: 15 is an amino acid sequence according to any one of SEQ ID NOs: 339 to 343.

Embodiment 10

The method according to embodiment 9, wherein the amino acid sequence of the mutant enzymatic activity exhibiting moiety differs from the amino acid sequence of any one of SEQ ID NOs: 339 to 343 at the following position(s) of the amino acid sequence according to any one of SEQ ID NOs: 339 to 343, or at amino acid position(s) corresponding thereto:

a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85,
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 11

The method according to any one of embodiments 1 and 10, wherein the mutant enzymatic activity exhibiting moiety is a polymerase activity exhibiting moiety.

Embodiment 12

The method according to any one of embodiments 1 to 11, wherein the mutant enzymatic activity is a polymerase activity.

Embodiment 13

The method according to embodiment 12, wherein the polymerase activity is a thermostable polymerase activity.

Embodiment 14

The method according to any one of embodiments 12 to 13, wherein the polymerase activity is a DNA-polymerase activity.

Embodiment 15

The method according to embodiment 14, wherein the DNA-polymerase activity is a DNA-dependent DNA-polymerase activity.

Embodiment 16

The method according to any one of embodiments 1 to 15, wherein the mutant enzymatic activity exhibiting moiety is an enzyme.

Embodiment 17

The method according to any one of embodiments 11 to 16, wherein the polymerase activity exhibiting moiety is a polymerase.

Embodiment 18

The method according to any one of embodiments 1 to 17, wherein the step of reacting is carried out under conditions which allow the adding of the at least one or more L-nucleotides to the first L-nucleic acid, preferably allow the adding of 5 to 20,000 L-nucleotides, preferably 10 to 2,000 L-nucleotides, more preferably 50 to 500 L-nucleotides, most preferably 50 to 100 L-nucleotides.

Embodiment 19

The method according to any one of embodiments 1 to 18, wherein the adding of the at least one or more L-nucleotides to the first L-nucleic acid is covalent binding of the at least one or more L-nucleotides to the first L-nucleic acid, preferably by forming a 3'-5' phosphodiester linkage between the 3'OH of the first L-nucleic acid and the 5' phosphate of one of the at least one or more L-nucleotides.

Embodiment 20

The method according to any one of embodiments 1 to 19, wherein the first L-nucleic acid is a primer consisting of DNA, RNA, modified DNA, modified RNA or combinations thereof.

Embodiment 21

The method according to any one of embodiments 1 to 20, wherein the first L-nucleic acid consists of L-nucleotides and optionally a modification.

Embodiment 22

The method according to any one of embodiments 1 to 21, wherein the first L-nucleic acid consists of L-nucleotides.

Embodiment 23

The method according to any one of embodiments 1 to 22, wherein the reaction further comprises a second L-nucleic acid, wherein one molecule of the first L-nucleic acid is hybridized to one molecule of the second L-nucleic acid, preferably through Watson-Crick base pairing.

Embodiment 24

The method according to embodiment 23, wherein the polymerase activity exhibiting moiety synthesizes a third L-nucleic acid that is complementary to the second L-nucleic acid, wherein the third L-nucleic acid comprise the first L-nucleic acid and the L-nucleotides added to the 3'end of the first L-nucleic acid.

Embodiment 25

A method for amplifying a target L-nucleic acid in the presence of L-nucleotides and a protein comprising a mutant enzymatic activity exhibiting moiety wherein the mutant enzymatic activity exhibiting moiety is capable of amplifying the target L-nucleic acid,
wherein the mutant enzymatic activity exhibiting moiety comprises an amino acid sequence, wherein the amino acids of the amino acid sequence are D-amino acids,
wherein the mutant enzymatic activity exhibiting moiety is a variant of an enzymatic activity exhibiting moiety, wherein the enzymatic activity exhibiting moiety consists of an amino acid sequence according to SEQ ID NO: 15 and wherein the amino acids of the amino acid sequence according to SEQ ID NO: 15 are D-amino acids,
wherein the amino acid sequence of the mutant enzymatic activity exhibiting moiety differs from the amino acid sequence of the enzymatic activity exhibiting moiety consisting of an amino acid sequence according to SEQ ID NO: 15 at least at one amino acid position, preferably at three amino acid positions, and/or
wherein the amino acid sequence of the mutant enzymatic activity exhibiting moiety is a truncated form of an amino acid sequence according to SEQ ID NO: 15, and wherein the amino acid sequence of the mutant enzymatic activity exhibiting moiety is different from an amino acid sequence according to any of SEQ ID NOs 15 to 22 and 51.

Embodiment 26

The method according to embodiment 25, wherein the amino acid sequence of the mutant enzymatic activity exhibiting moiety differs from the amino acid sequence of the enzymatic activity exhibiting moiety consisting of an amino acid sequence according to SEQ ID NO: 15 at the following amino acid position(s) of the amino acid sequence according to SEQ ID NO: 15 or at amino acid position(s) corresponding thereto:
a) at least one of amino acid positions 71, 76, 67, or 86, or
b) amino acid position 155 or 203 and 71; or
c) amino acid position 155 or 203 and 31; or
d) amino acid position 155 or 203 and 76; or
e) amino acid position 155 or 203 and 67; or
f) amino acid position 155 or 203 and 86; or
g) amino acid position 155 or 203 and 96, or
h) amino acid position 155 or 203 and 85, or
i) amino acid position 155 and 203 and 71, or
j) amino acid position 155 and 203 and 86, or
k) amino acid position 155 and 203 and 31, or
l) amino acid position 155 and 203 and 76, or
m) amino acid position 155 and 203 and 67, or
n) amino acid position 155 and 203 and 86, or
o) amino acid position 155 and 203 and 96, or
p) amino acid position 155 and 203 and 85,
wherein preferably in any one of a) to p) the amino acid at positions 155, 203, 71, 67, 85 and 96 are substituted by cysteine, the amino acid at position 31 is substituted by serine, the amino acid at position 76 is substituted by glycine or alanine, and the amino acid at position 86 is substituted by glycine or cysteine.

Embodiment 27

The method according to embodiment 26, wherein the mutant enzymatic activity exhibiting moiety comprises an amino acid sequence according to any one of SEQ ID NOs 89 to 120, preferably an amino acid sequence according to SEQ ID NO: 89 or an amino acid sequence according to SEQ ID NO: 90 or an amino acid sequence according to SEQ ID NO: 94 or an amino acid sequence according to SEQ ID NO: 97, more preferably an amino acid sequence according to SEQ ID NO: 94 or an amino acid sequence according to SEQ ID NO: 97, most preferably an amino acid sequence according to SEQ ID NO: 94.

Embodiment 28

The method according to embodiment 25, wherein the amino acid sequence of the mutant enzymatic activity exhibiting moiety is a truncated form of an amino acid sequence according to SEQ ID NO: 15, wherein the truncated form is lacking the n C-terminal amino acids of the amino acid sequence according to SEQ ID NO: 15, wherein n is any integer selected from the group comprising 1, 2, 3, 4, 5, 6, 7, 8, 9, 10, 11, 12, 13, 14, and 15.

Embodiment 29

The method according to any one of embodiments 25 and 28, wherein the mutant enzymatic activity exhibiting moiety comprises an amino acid sequence according to any one of SEQ ID NOs 121, 161, 201, 241 and 281.

Embodiment 30

The method according to any one of embodiments 25 and 28, wherein the mutant enzymatic activity exhibiting moiety comprises an amino acid sequence that differs from an amino acid sequence of a truncated form of an amino acid sequence according to SEQ ID NO: 15 at least at one amino acid position, preferably at three amino acid positions, wherein the truncated form of an amino acid sequence according to SEQ ID NO: 15 is an amino acid sequence according to any one of SEQ ID NOs: 121, 161, 201, 241 and 281.

Embodiment 31

The method according to embodiment 30, wherein the amino acid sequence of the mutant enzymatic activity exhibiting moiety differs from the amino acid sequence any one of SEQ ID NOs: 121, 161, 201, 241 and 281 at the following position(s) of the amino acid sequence according to any one of SEQ ID NOs: 121, 161, 201, 241 and 281 or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85, wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine,
wherein more preferably the amino acid sequence of the mutant enzymatic activity exhibiting moiety comprises an amino acid sequence according to any one of SEQ ID NOs 122 to 160, 162 to 200, 202 to 240, 242 to 280, and 282 to 338, wherein most preferably the amino acid sequence of the mutant enzymatic activity exhibiting moiety comprises an amino acid sequence according to any one of SEQ ID NOs 135, 174, 214, 254, 294.

Embodiment 32

The method according to embodiment 25, wherein the mutant enzymatic activity exhibiting moiety comprises an amino acid sequence according to any one of SEQ ID NOs 339 to 343.

Embodiment 33

The method according to embodiment 25, wherein the mutant enzymatic activity exhibiting moiety comprises an amino acid sequence that differs from a mutant form of an amino acid sequence according to SEQ ID NO: 15 at least at one amino acid position, preferably at three amino acid positions, wherein the mutant form of an amino acid sequence according to SEQ ID NO: 15 is an amino acid sequence according to any one of SEQ ID NOs: 339 to 343.

Embodiment 34

The method according to embodiment 33, wherein the amino acid sequence of the mutant enzymatic activity exhibiting moiety differs from the amino acid sequence of any one of SEQ ID NOs: 339 to 343 at the following position(s) of the amino acid sequence according to any one of SEQ ID NOs: 339 to 343, or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85, wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 35

The method according to any one of embodiments 25 to 34, wherein the enzymatic activity exhibiting moiety is a polymerase activity exhibiting moiety.

Embodiment 36

The method according to any one of embodiments 25 to 35, wherein the enzymatic activity is a polymerase activity.

Embodiment 37

The method according to embodiment 36, wherein the polymerase activity is a thermostable polymerase activity.

Embodiment 38

The method according to any one of embodiments 36 to 37, wherein the polymerase activity is a DNA-polymerase activity.

Embodiment 39

The method according to embodiment 38, wherein the DNA-polymerase activity is a DNA-dependent DNA-polymerase activity.

Embodiment 40

The method according to any one of embodiments 25 to 39, wherein the enzymatic activity exhibiting moiety is an enzyme.

Embodiment 41

The method according to any one of embodiments 35 to 40, wherein the polymerase activity exhibiting moiety is a polymerase.

Embodiment 42

The method according to any one of embodiments 25 to 41, wherein the step of reacting is carried out under conditions which allow the amplification of the target L-nucleic acid.

Embodiment 43

The method according to any one of embodiments 25 to 42, wherein the method makes use of at least one primer, preferably two primers, wherein the at least one primer consists of L-nucleotides and optionally a modification.

Embodiment 44

The method according to embodiment 43, wherein the primers consist of L-nucleotides.

Embodiment 45

The method according to any one of embodiment 25 to 44, wherein the target L-nucleic acid consists of L-nucleotides.

Embodiment 46

The method according to any one of embodiments 25 to 45, wherein the method is a polymerase chain reaction.

Embodiment 47

The method according to any one of embodiments 25 to 46, wherein the target L-nucleic acid consists of L-DNA.

Embodiment 48

The method according to any one of embodiments 25 to 47, wherein the target L-nucleic acid consists of 20 to 20,000 L-nucleotides, preferably 30 to 2,000 L-nucleotides, more preferably 40 to 500 L-nucleotides, most preferably 50 to 100 L-nucleotides.

Embodiment 49

A protein comprising a mutant enzymatic activity exhibiting moiety, wherein the mutant enzymatic activity exhibiting moiety comprises an amino acid sequence, wherein the amino acids of the amino acid sequence are D-amino acids, wherein the mutant enzymatic activity is capable of adding one or more L-nucleotides to the 3' end of the first L-nucleic acid,
wherein the mutant enzymatic activity exhibiting moiety is a variant of an enzymatic activity exhibiting moiety, wherein the enzymatic activity exhibiting moiety consists of an amino acid sequence according to SEQ ID NO: 15 and wherein the amino acids of the amino acid sequence according to SEQ ID NO: 15 are D-amino acids,
wherein the amino acid sequence of the mutant enzymatic activity exhibiting moiety differs from the amino acid sequence of the enzymatic activity exhibiting moiety consisting of an amino acid sequence according to SEQ ID NO: 15 at least at one amino acid position, preferably at three amino acid positions, and/or
wherein the amino acid sequence of the mutant enzymatic activity exhibiting moiety is a truncated form of an amino acid sequence according to SEQ ID NO: 15, and wherein the amino acid sequence of the mutant enzymatic activity exhibiting moiety is different from an amino acid sequence according to any of SEQ ID NOs 15 to 22 and 51.

Embodiment 50

The protein according to embodiment 49, wherein the amino acid sequence of the mutant enzymatic activity exhibiting moiety differs from the amino acid sequence of the enzymatic activity exhibiting moiety consisting of an amino acid sequence according to SEQ ID NO: 15 at the following amino acid position(s) of the amino acid sequence according to SEQ ID NO: 15 or at amino acid position(s) corresponding thereto:
a) at least one of amino acid positions 71, 76, 67, or 86, or
b) amino acid position 155 or 203 and 71; or
c) amino acid position 155 or 203 and 31; or
d) amino acid position 155 or 203 and 76; or
e) amino acid position 155 or 203 and 67; or
f) amino acid position 155 or 203 and 86; or
g) amino acid position 155 or 203 and 96, or
h) amino acid position 155 or 203 and 85, or
i) amino acid position 155 and 203 and 71, or
j) amino acid position 155 and 203 and 86, or
k) amino acid position 155 and 203 and 31, or
l) amino acid position 155 and 203 and 76, or
m) amino acid position 155 and 203 and 67, or
n) amino acid position 155 and 203 and 86, or
o) amino acid position 155 and 203 and 96, or
p) amino acid position 155 and 203 and 85,
wherein preferably in any one of a) to p) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 51

The protein according to embodiment 50, wherein the mutant enzymatic activity exhibiting moiety comprises an amino acid sequence according to any one of SEQ ID NOs 89 to 120, preferably an amino acid sequence according to SEQ ID NO: 89 or an amino acid sequence according to SEQ ID NO: 90 or an amino acid sequence according to SEQ ID NO: 94 or an amino acid sequence according to SEQ ID NO: 97, more preferably an amino acid sequence according to SEQ ID NO: 94 or an amino acid sequence according to SEQ ID NO: 97, most preferably an amino acid sequence according to SEQ ID NO: 94.

Embodiment 52

The protein according to claim 49, wherein the amino acid sequence of the mutant enzymatic activity exhibiting moiety is a truncated form of an amino acid sequence according to SEQ ID NO: 15, wherein the truncated form is lacking the n C-terminal amino acids of the amino acid sequence according to SEQ ID NO: 15, wherein n is any integer selected from the group comprising 1, 2, 3, 4, 5, 6, 7, 8, 9, 10, 11, 12, 13, 14, and 15.

Embodiment 53

The protein according to any one of embodiments 49 and 52, wherein the mutant enzymatic activity exhibiting moiety comprises an amino acid sequence according to any one of SEQ ID NOs: 121, 161, 201, 241 and 281.

Embodiment 54

The protein according to any one of embodiments 49 and 52, wherein the mutant enzymatic activity exhibiting moiety comprises an amino acid sequence that differs from an amino acid sequence of a truncated form of an amino acid sequence according to SEQ ID NO: 15 at least at one amino acid position, preferably at three amino acid positions, wherein the truncated form of an amino acid sequence according to SEQ ID NO: 15 is an amino acid sequence according to any one of SEQ ID NOs: 121, 161, 201, 241 and 281.

Embodiment 55

The protein according to embodiment 54, wherein the amino acid sequence of the mutant enzymatic activity exhibiting moiety differs from the amino acid sequence of any one of SEQ ID NOs: 121, 161, 201, 241 and 281 at the following position(s) of the amino acid sequence according to any one of SEQ ID NOs: 121, 161, 201, 241 and 281 or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85,
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine,
wherein more preferably the amino acid sequence of the protein comprises an amino acid sequence according to any one of SEQ ID NOs 122 to 160, 162 to 200, 202 to 240, 242 to 280, and 282 to 338, wherein most preferably the amino acid sequence of the mutant enzymatic activity exhibiting moiety comprises an amino acid sequence according to any one of SEQ ID NOs 135, 174, 214, 254, 294.

Embodiment 56

The protein according to embodiment 49, wherein the mutant enzymatic activity exhibiting moiety comprises an amino acid sequence according to any one of SEQ ID NOs 339 to 343.

Embodiment 57

The protein according to embodiment 49, wherein the mutant enzymatic activity exhibiting moiety comprises an amino acid sequence that differs from a mutant form of an amino acid sequence according to SEQ ID NO: 15 at least at one amino acid position, preferably at three amino acid positions, wherein the mutant form of an amino acid sequence according to SEQ ID NO: 15 is an amino acid sequence according to any one of SEQ ID NOs: 339 to 343.

Embodiment 58

The protein according to embodiment 57, wherein the amino acid sequence of the mutant enzymatic activity exhibiting moiety differs from the amino acid sequence of any one of SEQ ID NOs: 339 to 343 at the following position(s) of the amino acid sequence according to any one of SEQ ID NOs: 339 to 343, or at amino acid position(s) corresponding thereto:
a) amino acid position 155 and/or 203 and/or 71, or
b) amino acid position 155 and/or 203 and/or 86, or c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85,
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 59

The protein according to any of embodiments 49 to 58, wherein the mutant enzymatic activity exhibiting moiety is a polymerase activity exhibiting moiety.

Embodiment 60

The protein according to embodiment 49 to 59, wherein the mutant enzymatic activity is a polymerase activity.

Embodiment 61

The protein according to embodiment 60, wherein the polymerase activity is a thermostable polymerase activity.

Embodiment 62

The protein according to any one of embodiments 60 to 61, wherein the polymerase activity is a DNA-polymerase activity.

Embodiment 63

The protein according to embodiment 62, wherein the DNA-polymerase activity is a DNA-dependent DNA-polymerase activity.

Embodiment 64

The protein according to any one of embodiments 49 to 63, wherein the mutant enzymatic activity exhibiting moiety is an enzyme.

Embodiment 65

The protein according to any one of embodiments 59 to 63, wherein the polymerase activity exhibiting moiety is a polymerase.

Embodiment 66

A polymerase variant of a wild type polymerase,
wherein the polymerase variant comprises an amino acid sequence, preferably the amino acids of the amino acid sequence are D-amino acids,
wherein the wild type polymerase consists of an amino acid sequence according to SEQ ID NO: 15, preferably the amino acids of the amino acid sequence according to SEQ ID NO: 15 are D-amino acids,
wherein the amino acid sequence of the polymerase variant differs from the amino acid sequence of the wild type polymerase at least at one amino acid position, preferably at three amino acid positions, and/or
wherein the amino acid sequence of the polymerase variant is a truncated form of an amino acid sequence according to SEQ ID NO: 15, and
wherein the amino acid sequence of the polymerase variant is different from an amino acid sequence according to any of SEQ ID NOs 15 to 22 and 51.

Embodiment 67

The polymerase variant according to embodiment 66, wherein the amino acid sequence of the polymerase variant differs from the amino acid sequence of the wild type polymerase consisting of an amino acid sequence according to SEQ ID NO: 15 at the following amino acid position(s) of the amino acid sequence according to SEQ ID NO: 15 or at amino acid position(s) corresponding thereto:
a) at least one of amino acid positions 71, 76, 67, or 86, or
b) amino acid position 155 or 203 and 71; or
c) amino acid position 155 or 203 and 31; or
d) amino acid position 155 or 203 and 76; or
e) amino acid position 155 or 203 and 67; or
f) amino acid position 155 or 203 and 86; or
g) amino acid position 155 or 203 and 96, or
h) amino acid position 155 or 203 and 85, or
i) amino acid position 155 and 203 and 71, or
j) amino acid position 155 and 203 and 86, or
k) amino acid position 155 and 203 and 31, or
l) amino acid position 155 and 203 and 76, or
m) amino acid position 155 and 203 and 67, or
n) amino acid position 155 and 203 and 86, or
o) amino acid position 155 and 203 and 96, or
p) amino acid position 155 and 203 and 85,
wherein preferably in any one of a) to p) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 68

The polymerase variant according to embodiment 67, wherein the polymerase variant comprises an amino acid sequence according to any one of SEQ ID NOs 89 to 120, preferably an amino acid sequence according to SEQ ID NO: 89 or an amino acid sequence according to SEQ ID NO: 90 or an amino acid sequence according to SEQ ID NO: 94 or an amino acid sequence according to SEQ ID NO: 97, more preferably an amino acid sequence according to SEQ ID NO: 94 or an amino acid sequence according to SEQ ID NO: 97, most preferably an amino acid sequence according to SEQ ID NO: 94.

Embodiment 69

The polymerase variant according to embodiment 66, wherein the amino acid sequence of the polymerase variant is a truncated form of an amino acid sequence according to SEQ ID NO: 15, wherein the truncated form is lacking the n C-terminal amino acids of the amino acid sequence according to SEQ ID NO: 15, wherein n is any integer selected from the group comprising 1, 2, 3, 4, 5, 6, 7, 8, 9, 10, 11, 12, 13, 14, and 15

Embodiment 70

The polymerase variant according to any one of embodiments 66 and 69, wherein the polymerase variant comprises an amino acid sequence according to any one of SEQ ID NOs 121, 161, 201, 241 and 281.

Embodiment 71

The polymerase variant according to any one of embodiments 66 and 69, wherein the polymerase variant comprises an amino acid sequence that differs from an amino acid sequence of a truncated form of an amino acid sequence according to SEQ ID NO: 15 at least at one amino acid position, preferably at three amino acid positions, wherein the truncated form of an amino acid sequence according to SEQ ID NO: 15 is an amino acid sequence according to any one of SEQ ID NOs: 121, 161, 201, 241 and 281.

Embodiment 72

The polymerase variant according to embodiment 71, wherein the amino acid sequence of the polymerase variant differs from the amino acid sequence any one of SEQ ID NOs: 121, 161, 201, 241 and 281 at the following position(s) of the amino acid sequence according to any one of SEQ ID NOs: 121, 161, 201, 241 and 281 or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85,
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine,
wherein more preferably the amino acid sequence of the polymerase variant comprises an amino acid sequence according to any one of SEQ ID NOs 122 to 160, 162 to 200, 202 to 240, 242 to 280, and 282 to 338, wherein most preferably the amino acid sequence of the polymerase variant comprises an amino acid sequence according to any one of SEQ ID NOs 135, 174, 214, 254, 294.

Embodiment 73

The polymerase variant according to embodiment 66, wherein the polymerase variant comprises an amino acid sequence according to any one of SEQ ID NOs 339 to 343.

Embodiment 74

The polymerase variant according to embodiment 66, wherein the polymerase variant comprises an amino acid sequence that differs from a mutant form of an amino acid sequence according to SEQ ID NO: 15 at least at one amino acid position, preferably at three amino acid positions, wherein the mutant form of an amino acid sequence according to SEQ ID NO: 15 is an amino acid sequence according to any one of SEQ ID NOs: 339 to 343.

Embodiment 75

The polymerase variant according to embodiment 74, wherein the amino acid sequence of the polymerase variant differs from the amino acid sequence of any one of SEQ ID NOs: 339 to 343 at the following position(s) of the amino acid sequence according to any one of SEQ ID NOs: 339 to 343, or at amino acid position(s) corresponding thereto:
a) amino acid position 155 and/or 203 and/or 71, or
b) amino acid position 155 and/or 203 and/or 86, or
c) amino acid position 155 and/or 203 and/or 31, or
d) amino acid position 155 and/or 203 and/or 76, or
e) amino acid position 155 and/or 203 and/or 67, or
f) amino acid position 155 and/or 203 and/or 86, or
g) amino acid position 155 and/or 203 and/or 96, or
h) amino acid position 155 and/or 203 and/or 85,
wherein preferably in any one of a) to h) the amino acid at positions 155, 203, 71, 67, 85 and 96 are substituted by cysteine, the amino acid at position 31 is substituted by serine, the amino acid at position 76 is substituted by glycine or alanine and the amino acid at position 86 is substituted by glycine or cysteine.

Embodiment 76

The polymerase variant according to any one of embodiments 66 to 75, wherein the amino acids of the amino acid sequence of the polymerase variant are D-amino acids.

Embodiment 77

The polymerase variant according to any one of embodiments 66 to 75, wherein the amino acids of the amino acid sequence of the polymerase variant are L-amino acids.

Embodiment 78

Use of a protein comprising a mutant enzymatic activity exhibiting in a method for adding one or more L-nucleotides to the 3'end of an L-nucleic acid, wherein the protein is a protein according to any one of embodiments 49 to 65.

Embodiment 79

Use of a protein comprising a mutant enzymatic activity exhibiting moiety in a method for amplifying a target L-nucleic acid in the presence of L-nucleotides, wherein the protein is a protein according to any one of embodiments 49 to 65.

Embodiment 80

Use according to embodiment 79, wherein the method for amplifying a target L-nucleic acid is a polymerase chain reaction.

Embodiment 81

A method for the identification of a target molecule binding L-nucleic acid molecule comprising the following steps of
(a) generating a heterogeneous population of L-nucleic acid molecules;
(b) contacting the heterogeneous population of L-nucleic acid molecules of step (a) with the target molecule;
(c) separating the L-nucleic acid molecules which are not bound by the target molecule; and
(d) amplifying the L-nucleic acid molecules which are bound by the target molecule, wherein the step of amplification uses a protein, wherein the protein is a protein according to any one of embodiments 49 to 65.

Embodiment 82

The method according to embodiment 81, further comprising the step of
(e) sequencing the L-nucleic acid molecules which are bound by the target molecule; and
(f) synthesizing nucleic acid molecules the nucleotide sequence of which is identical to the nucleotide sequence of the L-nucleic acid molecules sequenced in step (e).

Embodiment 83

The method according to any one of embodiments 81 to 82, wherein the nucleic acid molecules of the heterogeneous population of L-nucleic acid molecules of step (a) comprise at their 5' end and their 3' end a primer binding site and, respectively, a sequence which is complementary to a primer binding site which allow amplification of the L-nucleic acid molecules obtained in step (d) by a polymerase chain reaction, wherein the polymerase used in the polymerase chain reaction is a protein according to any one of embodiments 49 to 65, the primers used in the polymerase chain reaction consist of L-nucleotides, and the nucleotides used in the polymerase chain reaction are L-nucleotides.

Embodiment 84

The method according to any one of embodiments 81 to 83, wherein after step (d) the following step is introduced:
(da) contacting the amplified nucleic acid molecules with the target molecule, wherein
step (b) and optionally steps (c) and/or (d) are carried out prior to step (e), wherein steps (da), (b), (c) and optionally (d) are carried out in this order one or several times.

Embodiment 85

The method according to any one of embodiments 81 to 84, wherein the target molecule binding L-nucleic acid is a DNA.

Embodiment 86

The method according to any one of embodiments 81 to 85, wherein the target molecule binding L-nucleic acid molecule consists of L-nucleotides.

Embodiment 87

A method for producing a protein, wherein the protein consists of an amino acid sequence, wherein the amino acids of the amino acid sequence are D-amino acids, wherein
a) two or more fragments of the protein are chemically synthesized, whereby the fragments in their entirety form the amino acid sequence of the protein, preferably the fragments are synthesized by solid phase peptide synthesis, and
b) the fragments of step a) are ligated to each other by segment condensation, native chemical ligation, enzymatic ligation or combinations thereof,
wherein the protein is protein according to any one of embodiments 49 to 65.

Embodiment 88

The method for producing a protein according to embodiment 87, wherein the enzyme that is used in enzymatic ligation is Clostripain.

The present inventors have surprisingly found that it is possible to chemically synthesize proteins consisting of D-amino acids which are functionally active, whereby such proteins have a size as typically displayed by a polymerase. More specifically, the present inventors have perceived a method which allows the synthesis of such D-proteins and of D-polymerases, i.e. polymerases consisting of D-amino acids, which are active as polymerases. Based on this surprising finding, the proteins and enzymatic activities required for the enzymatic synthesis of L-nucleic acids and L-nucleic acid molecules are now available. Such enzymatic synthesis of L-nucleic acids and L-nucleic acid molecules comprises, but is not limited to, a method for adding one or more L-nucleotides to the 3'end of a first L-nucleic acid and a method for amplifying a target L-nucleic acid in the presence of L-nucleotides as an L-nucleic acid, i.e. the amplification product is an L-nucleic acid.

As these methods and enzymatic activities are part of an alternative process of identifying spiegelmers making use of, such alternative process of identifying spiegelmers can now be put into practice.

The present inventors have developed a method for adding one or more L-nucleotides to the 3'end of a first L-nucleic acid, wherein the method comprises the step of reacting the one or more L-nucleotides with the first L-nucleic acid in the presence of a protein comprising an enzymatic activity exhibiting moiety, wherein the enzymatic activity is capable of adding one or more L-nucleotides to the 3' end of the first L-nucleic acid.

In a preferred embodiment enzymatic activity is capable of adding of 5 to 20,000 L-nucleotides to the 3' end of the first L-nucleic acid, preferably 10 to 2,000 L-nucleotides, more preferably 50 to 500 L-nucleotides, most preferably 50 to 100 L-nucleotides.

The term adding as preferably used herein is covalent binding between to molecules, according the present invention the covalent binding of an L-nucleic acid and of the at least one or more L-nucleotides to the L-nucleic acid, preferably by forming a 3'-5' phosphodiester linkage between the 3'OH of the first L-nucleic acid and the 5' phosphate of one of the at least one or more L-nucleotides. According to the present invention the L-nucleotide added to the L-nucleic acid forms the 3' end of the L-nucleic acid prolonged by said L-nucleotide.

In a preferred embodiment the method for adding one or more L-nucleotides to the 3'end of a first L-nucleic acid, comprises a second L-nucleic acid, wherein one molecule of the first L-nucleic acid is hybridized to one molecule of the second L-nucleic acid, preferably through Watson-Crick base pairing. In a more preferred embodiment the method allows the synthesize of a third L-nucleic acid that is complementary to the second L-nucleic acid, wherein the third L-nucleic acid comprise the first L-nucleic acid and the L-nucleotides added to the 3'end of the first L-nucleic acid, i.e. to the first L-nucleic acid one or more L-nucleotides are added to 3'end of a first L-nucleic acid resulting in the third L-nucleic acid.

The protein comprising an enzymatic activity exhibiting moiety according to the present invention comprises proteins that soley have an enzymatic activity exhibiting moiety and proteins that have an enzymatic activity exhibiting moiety and other residues or parts, wherein other residues or parts of the protein have no enzymatic activity. According to the present invention the amino acid sequence of the enzymatic activity exhibiting moiety comprises between 300 and 900 amino acids, preferably 300 and 600 amino acids, more preferably between 300 and 360 amino acids, most preferably 340 to 360 amino acids.

The protein comprising an enzymatic activity exhibiting moiety according to the present invention is preferably a polymerase activity exhibiting moiety. The protein comprising a polymerase activity exhibiting moiety according to the present invention comprises polymerases that soley have a polymerase activity exhibiting moiety and polymerases that have an polymerase activity exhibiting moiety and other residues or parts, wherein other residues or parts of the polymerase have no polymerase activity. According to the present invention the amino acid sequence of the polymerase activity exhibiting moiety comprises between 300 and 900 amino acids, preferably 300 and 600 amino acids, more preferably between 300 and 360 amino acids, most preferably 340 to 360 amino acids.

The polymerase activity exhibiting moiety according to the present invention is preferably a thermostable polymerase activity exhibiting moiety, more preferably a thermostable DNA polymerase activity exhibiting moiety and most preferably a thermostable DNA-dependant DNA-polymerase activity exhibiting moiety.

The polymerase activity exhibiting moiety according to the present invention is preferably a DNA-polymerase activity exhibiting moiety, more preferably a DNA-dependant DNA-polymerase activity exhibiting moiety or a thermostable DNA-polymerase activity exhibiting moiety, most preferably a thermostable DNA-dependant DNA-polymerase activity exhibiting moiety.

The term enzymatic activity as used herein is catalyzation of a specific reaction, preferably adding one or more nucleotides to the 3'end of an nucleic acid, amplication of an nucleic acid and/or a polymerase activity, more preferably adding one or more L-nucleotides to the 3'end of an L-nucleic acid and amplication of an L-nucleic acid.

The term polymerase activity according to the present invention is capability of an enzyme the polymerisation of L-nucleotides and/or polymerisation of L-nucleotides to an L-nucleic acid, wherein preferably the L-nucleotides are L-nucleoside triphosphates.

The polymerase activity according to the present invention is preferably a thermostable polymerase activity, more preferably a thermostable DNA polymerase activity and most preferably a thermostable DNA-dependant DNA-polymerase activity.

The polymerase activity according to the present invention is preferably a DNA-polymerase activity, more preferably a DNA-dependant DNA-polymerase or a thermostable DNA-polymerase activity, most preferably a thermostable DNA-dependant DNA-polymerase activity.

Known polymerases are from natural sources or are optimized or mutated variants of polymerases from natural sources. The polymerases consist of chiral building blocks, i.e. L-amino acids. Consequently, the structure of polymerases is inherently chiral as well, resulting in stereospecific substrate recognition. Hence, these enzymes only accept substrate molecules in the adequate, i.e. corresponding chiral configuration. Therefore known polymerases polymerize D-nucleotides or D-nucleoside triphosphates, wherein they use as a template strand a D-nucleic acid consisting of D-nucleotides to synthesize a complementary D-nucleic acid strand consisting of D-nucleotides. Additionally to the template strand the polymerase optionally use a primer that is hybridized to the template strand and consists of D-nucleotides. Since naturally occurring nucleic acids are composed of D-nucleotides and can be processed, e.g. amplified, by proteins and enzymes in particular consisting of L-amino acids, an L-nucleic acid is not recognized by such proteins and enzymes, respectively, consisting of L-amino acids. Accordingly, L-nucleic acids that bind to a target molecule or target structure, also referred to as spiegelmers, cannot be directly obtained by an in vitro selection process using the naturally occurring from of such target molecule or target structure.

The present inventors have surprisingly found that it is possible to produce a polymerase that can add an L-nucleic acid nucleotide to a primer consisting of L-nucleotides that is hybridized to an L-nucleic acid template strand. Moreover, the present inventors have surprisingly found that is possible to produce a polymerase that can be used for the amplification of an L-nucleic acid, preferably in a process that is known as polymerase-chain-reaction (abbr. PCR).

A polymerase is an enzyme that polymerizes nucleoside triphosphates. A polymerase uses a template nucleic acid strand to synthesize a nucleic acid strand which is complementary to the template nucleic acid strand. In addition to the template nucleic acid strand, the polymerase optionally uses a primer that is hybridized based on base complementarity to the template nucleic acid strand. The template nucleic acid strand, the primer and the nucleic acid strand synthesized by the polymerase can independently be either DNA or RNA. A polymerase as preferably used herein includes a DNA polymerase and an RNA-polymerase, preferably a DNA-dependent DNA polymerase, an RNA-dependent DNA polymerase such as a reverse transcriptase, an RNA-dependent RNA polymerase and an RNA-dependent DNA polymerase. More preferably, the polymerase is a thermostable polymerase. A polymerase does not need not to contain all of the amino acids found in a corresponding native or wild type enzyme, but only those which are sufficient to allow the polymerase to carry out a desired catalytic activity. In an embodiment a polymerase activity is catalytic activity which is selected from the group comprising Catalytic activities include, for example, 5'-3' polymerization, 5'-3' exonuclease, and 3'-5' exonuclease activities.

The polymerases according to the present invention consist of D-amino acids and polymerize L-nucleotides or L-nucleoside triphosphates, wherein the polymerases according to the present invention use as a template strand an L-nucleic acid consisting of L-nucleotides to synthesize a complementary L-nucleic acid strand consisting of L-nucleotides. Additionally to the template strand the polymerases according to the present invention optionally use a primer that is hybridized to the template strand and consists of L-nucleotides. The template strand, the primer and synthesized nucleic acid strand can independently be either L-DNA or L-RNA. The polymerases according to the present invention include DNA polymerases consisting of D-amino acids and RNA-polymerases consisting of D-amino acids, preferably DNA-dependent DNA polymerases consisting of D-amino acids, RNA-dependent DNA polymerases such reverse transcriptases consisting of D-amino acids, RNA-dependent RNA polymerases consisting of D-amino acids and RNA-dependent DNA polymerases consisting of D-amino acids. More preferably the polymerase according to the present invention is a thermostable polymerase consisting of D-amino acids. A polymerase according to the present invention need not contain all of the amino acids found in a native enzyme, but only those which are sufficient to allow the polymerases according to the present invention to carry out a desired catalytic activity. Catalytic activities include, for example, 5'-3' polymerization, 5'-3' exonuclease, and 3'-5' exonuclease activities.

A polymerase solely consisting of L-amino acids is preferably referred herein as 'all-L polymerase.'

A polymerase solely consisting of D-amino acids is preferably referred herein as 'all-D polymerase.'

In a preferred embodiment the polymerase according to the present invention is selected from the group of African Swine Fever Virus Polymerase X, *Thermus thermophilus* polymerase X core domain, rat Polymerase beta, eukaryotic Polymerase beta, Klenow Fragment, Klenow exo-polymerase, T4 DNA polymerase, Phi29 DNA polymerase, Sequenase, T7 DNA polymerase, SP6 Polymerase, DNA polymerase I, polymerase lambda, polymerase DPO4, preferably from *Sulfolobus solfataricus, Sulfolobus islandicus, Sulfolobus shibatae, Sulfolobus tengchongensis, Sulfolobus tokodaii, Sulfolobus acidocaldarius, Thermococcus litoralis* DNA polymerase, *Pyrococcus* sp. DNA polymerase, *Pyrococcus furiosus* DNA polymerase, Pfuturbo™ polymerase, *Sulfolobus solfataricus* DNA polymerase, *Thermococcus gorgonarius* DNA polymerase, KOD polymerase, Taq polymerase, Tth polymerase, Pyrobest polymerase, Pwo polymerase, Sac polymerase, Bst polymerase, Poc polymerase, Pab polymerase, Mth polymerase, Pho polymerase, ES4 polymerase, EX-Taq™ polymerase, LA-Tae™ polymerase, Expand™ polymerase, Platinum™ Taqpolymerases, Hi-Fi™ polymerase, Tbr polymerase, Tfl polymerase, Tru polymerase, Tac polymerase, Tne polymerase, Tma polymerase, Tih polymerase, Tfi polymerase, AmpliTae™, Stoffel Fragment, 9° Nm™ DNA Polymerase, Therminator™, Therminator II™, Phusion High Fidelity™ Polymerase, Pag5000™, Pfx-50™, Proofstart™, FideliTae™, Elongase™, and variants of each and any thereof.

In a more preferred embodiment the polymerase according to the present invention is the African Swine Fever Virus Polymerase X consisting of the amino acid sequence according to SEQ ID NO: 1. In another more preferred embodiment the polymerase according to the present invention is a variant of the African Swine Fever Virus Polymerase X, most preferably a variant of the African Swine Fever Virus Polymerase X of an amino acid sequence selected of an amino acid sequence selected from the group consisting of amino acid sequence according to SEQ ID NO: 2, amino acid sequence according to SEQ ID NO: 3 and amino acid sequence according to SEQ ID NO: 4.

In a more preferred embodiment the polymerase according to the present invention is a variant or mutant or mutant form or truncated form of the polymerase Dpo4, wherein the polymerase Dpo4 consists of the amino acid sequence according to SEQ ID NO: 15, and the variants or mutants or mutant form or truncated form of the polymerase Dpo4 comprise amino acid sequences according to any of SEQ ID NOs 89 to 343, wherein preferably the amino acids of the polymerase Dpo4 according to SEQ ID NO 15 and the amino acids of the variants or mutants or mutant form or truncated form of the polymerase Dpo4 according to any of SEQ ID NOs 89 to 343 are D-amino acids. In another more preferred embodiment the polymerase according to the present invention is a variant of the polymerase Dpo4, most preferably a variant of the polymerase Dpo4 consisting of an amino acid sequence selected of an amino acid sequence selected from the group consisting of amino acid sequence according to SEQ ID NO: 16, amino acid sequence according to SEQ ID NO: 17, amino acid sequence according to SEQ ID NO: 18, amino acid sequence according to SEQ ID NO: 19, amino acid sequence according to SEQ ID NO: 20, amino acid sequence according to SEQ ID NO: 21 and amino acid sequence according to SEQ ID NO: 22.

A variant or a mutant or mutant form or truncated form of a polymerase is a polymerase that differs from the amino acid sequence of the polymerase at one or more amino acid positions. The position of an amino acid in the amino acid sequence is preferably determined by its position to the N-terminus and the C-terminus of the polymerase and/or its position in respect to amino acids surrounding the amino acid, so that a) if the polymerase is truncated at the N-terminus the position of the amino acid is determined by its position to the C-terminus of the polymerase and in respect to amino acids surrounding the amino acid, b) if the polymerase is truncated at the C-terminus the position of the amino acid is determined by its position to the N-terminus of the polymerase and in respect to amino acids surrounding the amino acid, and b) if the polymerase is truncated at the N-terminus and the C-terminus the position of the amino acid is determined by its position in respect to amino acids surrounding the amino acid.

In an embodiment of the present invention the mutant enzymatic activity exhibiting moiety is a variant or a mutant or mutant form or truncated form of an enzymatic activity exhibiting moiety, wherein the enzymatic activity exhibiting moiety consists of an amino acid sequence according to SEQ ID NO: 15, wherein preferably the amino acids of enzymatic activity exhibiting moiety according to SEQ ID NO: 15 are D-amino acids, wherein the mutant enzymatic activity exhibiting moiety is mutated as disclosed herein, i.e. at least at one amino acid position of SEQ ID NO: 15, preferably at three amino acid positions of SEQ ID NO: 15.

Preferably, the mutant enzymatic activity exhibiting moiety comprises an amino acid sequence according to any one of SEQ ID NOs: 89 to 343, wherein more preferably the amino acids of the amino acid sequence according to any one of SEQ ID NOS. 89 to 343 are D-amino acids.

In a further embodiment of the present invention the mutant enzymatic activity exhibiting moiety is mutated as disclosed herein, i.e. the amino acid sequence of the mutant enzymatic activity exhibiting moiety is, compared to the amino acid sequence according to SEQ ID NO: 15, mutated at least at one amino acid position of SEQ ID NO: 15, preferably at three amino acid positions of SEQ ID NO: 15; in other words, the mutation(s) characteristic of the mutant enzymatic activity exhibiting moiety reside(s) in the stretch of the amino acid sequence of the mutant enzymatic activity exhibiting moiety which, except said mutation(s), is the amino acid sequence according to SEQ ID NO: 15 and thus in the amino acid sequence which is contained in both the mutant enzymatic activity exhibiting moiety and the enzymatic activity exhibiting moiety. In connection with such embodiment, the mutant enzymatic activity exhibiting moiety may comprise one or more additional amino acids which is/are attached to either or both of the N-terminus and the C-terminus of the amino acid sequence according to SEQ ID NO: 15.

A polymerases according to the present invention that is thermostable is relatively unaffected by elevated temperatures. In one specific, non-limiting example, a polymerase with of thermostability is unaffected by a temperature of at least 50° C., for example, 50° C., 60° C., 75° C., 80° C., 82° C., 85° C., 88° C., 90° C., 92° C., 95° C., or even higher temperatures.

Within the process of polymerisation of L-nucleoside triphosphates the polymerase adds one nucleoside triphosphate to another nucleoside triphosphate, preferably resulting in an oligonucleotide, also referred to as a nucleic acid. In a preferred embodiment the polymerase adds only one nucleoside triphosphate to one nucleoside triphosphate or to the terminal nucleotide of a nucleic acid, e.g. if the nucleotide is chain terminator nucleotides such as a dideoxynucleotide. Such chain terminator nucleotides are used for sequencing nucleic acids and known by skilled in the art.

The process of polymerisation of L-nucleoside triphosphates can be used for amplifying an L-nucleic acid, preferably a target L-nucleic acid.

Amplification is any process that increases the number of copies of a nucleic acid, preferably a target L-nucleic acid.

In a preferred embodiment the target L-nucleic acid consists of 20 to 20,000 L-nucleotides, preferably 30 to 2,000 L-nucleotides, more preferably 40 to 500 L-nucleotides, most preferably 50 to 100 L-nucleotides.

An example of amplification is in which a nucleic acid is contacted with a pair of primers, under conditions that allow for the hybridization of the primers to nucleic acid template. The primers are extended by the polymerase by adding one or more nucleoside triphosphates to the primer under suitable conditions, dissociated from the nucleic acid template, and then re-annealed, extended, and dissociated to amplify the number of copies of the nucleic acid molec. The product of in vitro amplification can be characterized by electrophoresis, restriction endonuclease cleavage patterns, oligonucleotide hybridization or ligation, and/or nucleic acid sequencing, using standard techniques.

Alternative in vitro amplification techniques are known by a person skilled in the art including transcription-free isothermal amplification, strand displacement amplification, and NASBA™ RNA transcription-free amplification.

Some of the amplifications method relies on thermal cycling, consisting of cycles of repeated heating and cooling of the reaction for melting of a nucleic acid, preferably a double-stranded nucleic acid, and enzymatic replication of the nucleic acid. These thermal cycling steps are necessary first to physically separate the two strands in of double stranded nucleic acid at a high temperature in a process called nucleic acid melting. At a lower temperature, each strand is then used as the template in nucleic acid synthesis by the polymerase to selectively amplify the target nucleic acid. Primers containing sequences complementary to the target region along with a polymerase (after which the method is named) are key components to enable selective and repeated amplification. As the amplification method based in thermal cycling progresses, the nucleic acid generated is itself used as a template for replication, setting in motion a chain reaction in which the nucleic acid template is exponentially amplified.

The most prominent amplification method by thermal amplification is the polymerase chain reaction (abbr. PCR).

Primers are short nucleic acid molecules consisting of DNA or RNA or combinations thereof, preferably DNA oligonucleotides 10 nucleotides or more in length. More preferably, longer primers can be about 15, 20, or 25 nucleotides or more in length. Primers can be annealed to a complementary target nucleic acid strand by nucleic acid hybridization to form a hybrid between the primer and the target nucleic acid strand, and then the primer extended along the target nucleic acid strand by a polymerase Primer pairs can be used for amplification of a nucleic acid, e.g., by the PCR or other nucleic-acid amplification methods known in the art.

The use the polymerase of the present invention consisting of D-amino acids makes is necessary that the primer and the complementary target nucleic acid strand consist of L-nucleotides. Preferably at least one primer consists of L-nucleotides and optionally a modification.

Methods for preparing and using nucleic acid primers and probes are described, for example, in Sambrook et al. (Sambrock et al., 1989). PCR primer pairs can be derived from a known sequence, for example, by using computer programs intended for that purpose such as Primer. One of ordinary skill in the art will appreciate that the specificity of a particular probe or primer increases with its length.

The polymerases according to the present invention consist of D-amino acids, preferably solely consist of D-amino acids. Because of that the polymerases according to the present invention consisting of D-amino acids can not be isolated from natural sources and can not be produced by recombinant expression using bacteria, yeast, fungi, viruses or animal cells and has to be produced by a chemical process, preferably such as solid-phase peptide synthesis (abbr. SPPS) in combination with ligation methods.

Solid-phase peptide synthesis is the state-of-the-art for the synthesis of peptides or fragments of proteins: Small solid beads, insoluble yet porous, are treated with functional units ('linkers') on which peptide chains can be built. The peptide will remain covalently attached to the bead until cleaved from it by a reagent such as anhydrous hydrogen fluoride or trifluoroacetic acid. The peptide is thus 'immobilized' on the solid-phase and can be retained during a filtration process, whereas liquid-phase reagents and by-products of synthesis are flushed away. The general principle of SPPS is one of repeated cycles of coupling-wash-deprotection-wash. The free N-terminal amine of a solid-phase attached peptide is coupled (see below) to a single N-protected amino acid unit. This unit is then deprotected, revealing a new N-terminal amine to which a further amino acid may be attached. The superiority of this technique partially lies in the ability to perform wash cycles after each reaction, removing excess reagent with all of the growing peptide of interest remaining covalently attached to the insoluble resin. There are two majorly used forms of SPPS Fmoc and Boc. The N-termini of amino acid monomers is protected by either of these two groups and added onto a deprotected amino acid chain. SPPS is limited by yields, and typically peptides and proteins in the range of 70 amino acids are pushing the limits of synthetic accessibility. Synthetic difficulty also is sequence dependent. Larger synthetic oligopeptides and proteins can be accessed by using ligation methods such as fragment condensation, native chemical ligation or enzymatic ligation to couple two peptides together. However, the largest D-protein synthesized so far is the D-protein form of the angiogenic protein vascular endothelial growth factor (abbr. VEGF-A) consisting of 102 D-amino acids (Mandal et al., 2012), Fragment condensation uses peptides wherein the side chains of the amino acids of the peptide are fully protected by chemical groups and the peptide are coupled in solution.

Native chemical ligation is carried out in aqueous solution. The challenge is the preparation of the necessary unprotected peptide-thioester building block. In native chemical ligation, the thiolate group of an N-terminal cysteine residue of an unprotected peptide 2 attacks the C-terminal thioester of a second unprotected peptide 1 in an aqueous buffer at pH 7.0, 20° C.<T<37° C. This reversible transthioesterification step is chemoselective and regioselective and leads to form a thioester intermediate 3. This intermediate rearranges by an intramolecular S,N-acyl shift that results in the formation of a native amide ('peptide') bond 4 at the ligation site.

As shown in the examples the inventors could surprisingly show that a C-terminal thioester that is necessary for native chemical ligation is stable under the conditions of enzymatic ligation, so that the native chemical ligation and enzymatic ligation can be used in combination.

Enzymatic ligation of D-peptides works by the use of proteases comprising the following steps: (a) preparation of an amino component, where said amino component is a uniquely D-peptide, (b) preparation of the carboxy component, where said carboxy component comprises a leaving group and is a uniquely D-peptide and (c) reaction of the amino component and the carboxy component in the presence of a protease to form a peptide bond between the amino component and the carboxy component with cleavage of the leaving group to give the uniquely D-polypeptide (see WO2003047743). Preferably the protease is Clostripain.

A polymerase of the present invention shall also comprise a polymerase which is essentially homologous to the polymerase of the present invention and in particular to the particular sequence(s) disclosed herein. The term substantially homologous shall be understood such as the homology is at least 75%, preferably 85%, more preferably 90% and most preferably more that 95%, 96%, 97%, 98% or 99%.

A polymerase activity exhibiting moiety of the present invention shall also comprise a polymerase activity exhibiting moiety which is essentially homologous to the polymerase activity exhibiting moiety of the present invention and in particular to the particular sequence(s) disclosed herein. The term substantially homologous shall be understood such as the homology is at least 75%, preferably 85%, more preferably 90% and most preferably more that 95%, 96%, 97%, 98% or 99%.

The actual percentage of homologous amino acids present in the polymerase of the present invention or polymerase activity exhibiting moiety of the present invention will depend on the total number of amino acids present in the polymerase or polymerase activity exhibiting moiety. The percent modification can be based upon the total number of amino acids present in the polymerase or polymerase activity exhibiting moiety.

The homology between two polymerases or two polymerase activity exhibiting moieties can be determined as known to the person skilled in the art. More specifically, a sequence comparison algorithm may be used for calculating the percent sequence homology for the test sequence(s) relative to the reference sequence, based on the designated program parameters. The test sequence is preferably the polymerase or polymerase activity exhibiting moiety which is said to be homologous or to be tested whether it is homologous, and if so, to what extent, to a different polymerase or polymerase activity exhibiting moiety, whereby such different polymerase or polymerase activity exhibiting moiety is also referred to as the homology reference sequence. Optimal alignment of amino acid sequences of the polymerase for comparison can be conducted, e.g., by the local homology algorithm of Smith & Waterman (Smith & Waterman, 1981) by the homology alignment algorithm of Needleman & Wunsch (Needleman & Wunsch, 1970) by the search for similarity method of Pearson & Lipman (Pearson & Lipman, 1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection.

One example of an algorithm that is suitable for determining percent sequence identity is the algorithm used in the basic local alignment search tool (hereinafter "BLAST"), see, e.g. Altschul et al (Altschul et al. 1990 and Altschul et al, 1997). Software for performing BLAST analyses is publicly available through the National Center for Biotechnology Information (hereinafter "NCBI"). The default parameters used in determining sequence identity using the software available from NCBI, e.g., BLASTN (for nucleotide sequences) and BLASTP (for amino acid sequences) are described in McGinnis et al (McGinnis et al, 2004).

A polymerase of the present invention shall also comprise polymerase which has a certain degree of identity relative to polymerase of the present invention and in particular to the particular polymerase of the present invention disclosed herein and defined by their amino acid sequence. More preferably, the instant invention also comprises those polymerases which have an identity of at least 75%, preferably 85%, more preferably 90% and most preferably more than 95%, 96%, 97%, 98% or 99% relative to the polymerase of the present invention and in particular to the particular polymerase of the present invention disclosed herein and defined by their amino acid sequence or a part thereof.

A polymerase activity exhibiting moiety of the present invention shall also comprise polymerase activity exhibiting moiety which has a certain degree of identity relative to polymerase activity exhibiting moiety of the present invention and in particular to the particular polymerase activity exhibiting moiety of the present invention disclosed herein and defined by their amino acid sequence. More preferably, the instant invention also comprises those polymerase activity exhibiting moieties which have an identity of at least 75%, preferably 85%, more preferably 90% and most preferably more than 95%, 96%, 97%, 98% or 99% relative to the polymerase activity exhibiting moiety of the present invention and in particular to the particular polymerase activity exhibiting moiety of the present invention disclosed herein and defined by their amino acid sequence or a part thereof.

In connection with the instant application the terms nucleic acid molecule and nucleic acid are used in an interchangeable manner if not explicitly indicated to the contrary.

As preferably used herein "nucleic acid" and "nucleic acid" refer to polynucleotides or oligonucleotides such as deoxyribonucleic acid (abbr. DNA) and ribonucleic acid (abbr. RNA). Moreover, the term "a nucleic acid" includes a plurality of nucleic acids. The terms "nucleic acid" and "nucleic acids" should also be understood to include, as equivalents, variants and analogs of either RNA or DNA made from nucleotide analogs, single (sense or antisense) and double-stranded polynucleotides or oligonucleotides. Deoxyribonucleotides include deoxyadenosine, deoxycytidine, deoxyguanosine and deoxythymidine. Ribonucleotides include adenosine, cytidine, guanosine and uridine. Reference to a nucleic acid molecule as a "polynucleotide" is used in its broadest sense to mean two or more nucleotides or nucleotide analogs linked by a covalent bond, including single stranded or double stranded molecules. The term "oligonucleotide" also is used herein to mean two or more nucleotides or nucleotide analogs linked by a covalent bond, although as defined herein oligonucleotides comprise less one hundred nucleotides.

The nucleic acid is characterized in that all of the consecutive nucleotides forming the nucleic acid are linked with or connected to each other by one or more than one covalent bond. More specifically, each of such nucleotides is linked with or connected to two other nucleotides, preferably through phosphodiester bonds or other bonds, forming a stretch of consecutive nucleotides. In such arrangement, however, the two terminal nucleotides, i.e. preferably the nucleotide at the 5' end and at the 3' end, are each linked to a single nucleotide only under the proviso that such arrangement is a linear and not a circular arrangement and thus a linear rather than a circular molecule.

In another embodiment of the present application the nucleic acid comprises at least two groups of consecutive nucleotides, whereby within each group of consecutive nucleotides each nucleotide is linked with or connected to two other nucleotides, preferably through phosphodiester bonds or other bonds, forming a stretch of consecutive nucleotides. In such arrangement, however, the two terminal nucleotides, i.e. preferably the nucleotide at the 5' end and at the 3' end, are each linked to a single nucleotide only. In such embodiment, the two groups of consecutive nucleotides, however, are not linked with or connected to each other through a covalent bond which links one nucleotide of one group and one nucleotide of another or the other group through a covalent bond, preferably a covalent bond formed between a sugar moiety of one of said two nucleotides and a phosphor moiety of the other of said two nucleotides or nucleosides. In an alternative embodiment, the two groups of consecutive nucleotides, however, are linked with or connected to each other through a covalent bond which links one nucleotide of one group and one nucleotide of another or the other group through a covalent bond, preferably a covalent bond formed between a sugar moiety of one of said two nucleotides and a phosphor moiety of the other of said two nucleotides or nucleosides. Preferably, the at least two groups of consecutive nucleotides are not linked through any covalent bond. In another preferred embodiment, the at least two groups are linked through a covalent bond which is different from a phosphodiester bond.

The term nucleic acid preferably also encompasses either a D-nucleic acid or a L-nucleic acid. Preferably, the nucleic acid is L-nucleic acid l. In addition it is possible that one or several parts of the nucleic acid is present as a D-nucleic acid and at least one or several parts of the nucleic acid is an L-nucleic acid. The term "part" of the nucleic acid shall mean as little as one nucleotide. Such nucleic acid is generally referred to herein as D- and L-nucleic acid, respectively. Therefore, in a preferred embodiment, the nucleic acid according to the present invention consist of L-nucleotides and comprise at least one D-nucleotide. Preferably, such D-nucleotide is attached at a terminus of any of the stretches and of any nucleic acid.

L-nucleic acid as used herein is a nucleic acid consisting of L-nucleotides, preferably consisting completely of L-nucleotides.

D-nucleic acid as used herein is nucleic acid consisting of D-nucleotides, preferably consisting completely of D-nucleotides.

Also, if not indicated to the contrary, any nucleotide sequence is set forth herein in 5'→3' direction.

Irrespective of whether the nucleic acid consists of D-nucleotides, L-nucleotides or a combination of both with the combination being e.g. a random combination or a defined sequence of stretches consisting of at least one L-nucleotide and at least one D-nucleic acid, the nucleic acid molecule may consist of desoxyribonucleotide(s), ribonucleotide(s) or combinations thereof.

Regardless of whether the nucleic acid is a D-nucleic acid, an L-nucleic acid, a mixture thereof, a DNA, or an RNA, or each and any combination thereof, the term nucleic acid as preferably used herein shall also encompass single-stranded nucleic acid and double-stranded nucleic acid, whereby preferably the nucleic acid molecule as subjected to the method according to the present invention is a single-stranded nucleic acid.

The term nucleic acid as preferably used herein, shall also encompass a modified nucleic acid. The modified nucleic acid can be a nucleotide-modified RNA or a nucleotide-modified DNA molecule, whereby the RNA or DNA molecules are extensively modified at the individual nucleotides to enhance stability by modification with nuclease resistant groups, for example, 2'-amino, 2'-C-allyl, 2'-fluoro, 2'-O-methyl, 2'-H (for a review see Usman & Cedergren, 1992).

The term nucleic acid as preferably used herein, shall also encompass a fully closed nucleic acid. A fully closed, i.e. circular structure for the nucleic acid is realized if the nucleic acid the nucleotide sequence of which is to be determined according to the present invention, is closed, preferably through a covalent linkage, whereby more preferably such covalent linkage is made between the 5' end and the 3' end of the nucleic acid molecules sequences as disclosed herein.

The term nucleic acid as preferably used shall also encompass any nucleic acid molecule which comprises a non-nucleic acid molecule moiety. Such non-nucleic acid molecule moiety may be selected from a group comprising peptides, oligopeptides, polypeptides, proteins, carbohydrates, various groups as will be outlined in more detail in the following. The term nucleic acid e shall thus also encompass conjugates and/or complexes comprising at least one nucleic acid moiety and at least one further moiety that can be used to facilitate delivery of nucleic acid molecules into a biological system, such as a cell. The conjugates and complexes provided can impart therapeutic activity by transferring therapeutic compounds across cellular membranes, altering the pharmacokinetics, and/or modulating the localization of nucleic acid of the invention. These kinds of conjugates and complexes are preferably suitable for the delivery of molecules, including, but not limited to, small molecules, lipids, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules into a number of cell types originating from different tissues, in the presence or absence of serum (see U.S. Pat. No. 5,854,038). Conjugates of the molecules described herein can be attached to biologically active molecules via linkers that are biodegradable, such as biodegradable nucleic acid linker molecules.

As will be detailed in the following in connection with the nucleic acid the sequence of which is to be determined, the non-nucleic acid moiety may be a PEG moiety, i.e. a poly(ethylene glycol) moiety, or a HES moiety, i.e. a hydroxyethyl starch moiety.

The non-nucleic acid moiety and preferably the PEG and/or HES moiety can be attached to the nucleic acid molecule either directly or through a linker. It is also within the present invention that the nucleic acid molecule comprises one or more modifications, preferably one or more PEG and/or HES moiety. In an embodiment the individual linker molecule attaches more than one PEG moiety or HES moiety to a nucleic acid molecule. The linker used in connection with the present invention can itself be either linear or branched. These kind of linkers are known to the ones skilled in the art and are further described in the patent applications WO 2005/074993 and WO 2003/035665.

In a preferred embodiment the linker is a biodegradable linker. The biodegradable linker allows to modify the characteristics of the nucleic acid molecules in terms of, among other, residence time in the animal body, preferably in the human body, due to release of the modification from the nucleic acid molecules. Usage of a biodegradable linker may allow a better control of the residence time of the nucleic acid molecules. A preferred embodiment of such biodegradable linkers are biodegradable linkers such as those described in but not restricted to the international patent applications WO 2006/052790, WO 2008/034122, WO 2004/092191 and WO 2005/099768, whereby in the international patent applications WO 2004/092191 and WO 2005/099768, the linker is part of a polymeric oligonucleotide prodrug, that consists of one or two modifications as described herein, a nucleic acid molecule and the biodegradable linker in between.

As preferably used herein, "nucleotides" include, but are not limited to, the naturally occurring DNA nucleoside mono-, di-, and triphosphates: deoxyadenosine mono-, di- and triphosphate; deoxyguanosine mono-, di- and triphosphate; deoxythymidine mono-, di- and triphosphate; and deoxycytidine mono-, di- and triphosphate. (referred to herein as dA, dG, dT and dC or A, G, T and C, respectively). The term nucleotides also includes the naturally occurring RNA nucleoside mono-, di-, and triphosphates: adenosine mono-, di- and triphosphate; guanine mono-, di- and triphosphate; uridine mono-, di- and triphosphate; and cytidine mono-, di- and triphosphate (referred to herein as A, G, U and C, respectively) refers to a base-sugar-phosphate combination that is the monomeric unit of a nucleic acid molecule, i. e., a DNA molecule and an RNA molecule. However, in other words, the term "nucleotides" refers to any compound containing a cyclic furanoside-type sugar (p-D/L-ribose in RNA and P-D/L-2'-deoxyribose in DNA), which is phosphorylated at the 5' position and has either a purine or pyrimidine-type base attached at the C-1'sugar position via a -glycosol C1'-N linkage. The nucleotides may be natural or synthetic, including a nucleotide that has been mass-modified including, inter alia, nucleotides having modified nucleosides with modified bases (e. g., 5-methyl cytosine) and modified sugar groups (e. g., 2'-O-methyl ribosyl, 2'-O-methoxyethyl ribosyl, 2'-fluoro ribosyl, 2'-amino ribosyl, and the like).

The term "nucleobase" covers the naturally occurring nucleobases adenine (A), guanine (G), cytosine (C), thymine (T) and uracil (U) as well as non-naturally occurring nucleobases such as xanthine, diaminopurine, 8-oxo-N6-methyladenine, 7-deazaxanthine, 7-deazaguanine, N4,N4-ethanocytosin, N6,N6-ethano-2,6-diaminopurine, 5-methylcytosine, 5~(C3-C6)-alkynyl-cytosine, 5-fluorouracil, 5-bromouracil, pseudoisocytosine, 2-hydroxy-5-methyl-4-triazolopyridin, isocytosine, isoguanine, inosine and the "non-naturally occurring" nucleobases described in the U.S. Pat. No. 5,432,272, in the publication of Freier & Altmann (Freier & Altmann, 1997). The term "nucleobase" thus includes not only the known purine and pyrimidine heterocycles, but also heterocyclic analogues and tautomers thereof.

It is within the present invention that the single-stranded nucleic acid can form distinct and stable three-dimensional structures and specifically bind to a target molecule like antibodies. Such nucleic acid molecules composed of D-nucleotides are called aptamers. Aptamers can be identified against several target molecules, e.g. small molecules, proteins, nucleic acids, and even cells, tissues and organisms and can inhibit the in vitro and/or in vivo function of the specific target molecule. Aptamers are usually identified by a target-directed selection process, called in vitro selection or Systematic Evolution of Ligands by Exponential Enrichment (abbr. SELEX) (Bock et al, 1992; Ellington & Szostak, 1990; Tuerk & Gold, 1990). Non-modified aptamers are cleared rapidly from the bloodstream, with a half-life of minutes to hours, mainly due to nuclease degradation and clearance from the body by the kidneys, a result of the aptamer's inherently low molecular weight. Hence, in order to use aptamers therapeutically they have to be modified at the 2' position of the sugar (e.g. ribose) backbone (Burmester et al, 2006).

The omnipresent nucleases which account for the instability of aptamers consist of chiral building blocks, i.e. L-amino acids. Consequently, the structure of nucleases is inherently chiral as well, resulting in stereospecific substrate recognition. Hence, these enzymes only accept substrate molecules in the adequate chiral configuration. Since aptamers and naturally occurring nucleic acid molecules are composed of D-nucleotides, an L-oligonucleotide should escape from enzymatic recognition and subsequent degradation. Due to the same principle, unfortunately in this case, nature developed no enzymatic activity to amplify such mirror-image nucleic acids. Accordingly, L-nucleic acid aptamers cannot be directly obtained employing the SELEX process. The principles of stereochemistry, though, reveal a detour which eventually leads to the desired functional L-nucleic acid aptamers.

If an in vitro selected (D-)aptamer binds its natural target, the structural mirror-image of this aptamer binds with the same characteristics the mirror-image of the natural target. Here, both interaction partners have the same (unnatural) chirality. Due to the homochirality of life and most biochemical compounds, such enantio-RNA ligands, of course, would be of limited practical use. If, on the other hand, the SELEX process is carried out against an (unnatural) mirror-image target, an aptamer recognizing this (unnatural) target will be obtained. The corresponding mirror-image configuration of said aptamer—the desired L-aptamer—in turn recognizes the natural target. This mirror-image selection process for the generation of biostable nucleic acid molecule was published first in 1996 (Klussmann et al, 1996; Nolte et al, 1996) and results in the generation of functional mirror-image nucleic acid molecule ligands that display not only high affinity and specificity for a given target molecule, but at the same time also biological stability. It is within the present invention that the single-stranded nucleic acid molecule is such a ligand-binding L-nucleic acid that is referred to as 'spiegelmer' (from the German word 'Spiegel', mirror) (see 'The Aptamer Handbook'; eds. Klussmann, 2006)

Among others, the nucleic acids according to the present invention may comprise a modification, which preferably allows the detection of the nucleic acids according to the present invention. Such a modification is preferably selected from the group comprising radioactive, enzymatic and fluorescent labels. Such modification is also selected from D-nucleotides that itself can by modified by a modification selected from the group comprising radioactive, enzymatic and fluorescent labels.

The various SEQ.ID.Nos., the chemical nature of the nucleic acids, peptides, oligopeptides and protein as used herein, the actual sequence thereof and the internal reference number is summarized in the following table.

TABLE 1(A)

SEQUENCES REFERRED TO IN THIS APPLICATION

| SEQ ID NO: | Type | Sequence | Internal Reference |
|---|---|---|---|
| 1 | Protein | MLTLIQGKKIVNHLRSRLAFEYNGQLIKILSKNIVAVGSLRREEKMLNDVDLLIIVPEKK LLKHVLPNIRIKGLSFSVKVCGERKCVLFIEWEKKTYQLDLFTALAEEKPYAIFHFTGPV SYLIRIRAALKKKNYKLNQYGLFKNQTLVPLKITTEKELIKELGFTYRIPKKRL | Pol-X, polymerase X |
| 2 | Protein | MLTLIQGKKIVNHLRSRLAFEYNGQLIKILSKNIVAVGSLRREEKMLNDVDLLIIVPEKK LLKHVLPNIRIKGLSFSVKGCGERKCVLFIEWEKKTYQLDLFTALAEEKPYAIFHFTGPV SYLIRIRAALKKKNYKLNQYGLFKNQTLVPLKITTEKELIKELGFTYRIPKKRL | Pol-X V80G, polymerase X variant V80G |
| 3 | Protein | MLTLIQGKKIVNHLRSRLAFEYNGQLIKILSKNIVAVGSLRREEKMLNDVDLLIIVPEKK LLKHVLPNIRIKGLSFSVKACGERKCVLFIEWEKKTYQLDLFTALAEEKPYAIFHFTGPV SYLIRIRAALKKKNYKLNQYGLFKNQTLVPLKITTEKELIKELGFTYRIPKKRL | Pol-X V80A, polymerase X variant V80A |
| 4 | Protein | MLTLIQGKKIVNHLRSRLAFEYNGQLIKILSKNIVAVGSLRREEKMLNDVDLLIIVPEKK LLKHVLPNIRIKGLSFSVKVCGERKCVLFIEWEKKTYQLDLFTALAEEKPYAIFHFTGPV SYLGRIRAALKKKNYKLNQYGLFKNQTLVPLKITTEKELIKELGFTYRIPKKRL | Pol-X I124G, polymerase X variant I124G |
| 5 | Protein | MLTLIQGKKIVNHLRSRLAFEYNGQLIKILSKNIVAVGSLRREEKMLNDVDLLIIVPEKK LLKHVLPNIRIKGLSFSVKVCGERKSSVLFIEWEKKTYQLDLFTALAEEKPYAIFHFTGPV SYLIRIRAALKKKNYKLNQYGLFKNQTLVPLKITTEKELIKELGFTYRIPKKRL | Pol-X C86S, polymerase X variant C86S |
| 6 | D/L-DNA | D(GG)-L(GATCACAGTGAGTAC) | MJ_1_58_MD |
| 7 | L-DNA | Phosphate-GTAAAACGACGGCCAGT | MJ_1_143_LD |
| 8 | L-DNA | ACTGGCCGTCGTTTTACAGTACTCACTGTGATC | MJ_1_145_LD |
| 9 | L-DNA | ACTGGCCGTCGTTTTACCGTACTCACTGTGATC | MJ_1_146_LD |
| 10 | L-DNA | ACTGGCCGTCGTTTTACGGTACTCACTGTGATC | MJ_1_147_LD |
| 11 | L-DNA | ACTGGCCGTCGTTTTACTGTACTCACTGTGATC | MJ_1_144_LD |
| 12 | D/L-DNA | D(GG)-L(GATCACAGTGAGTAC) | MJ_158_MD |
| 13 | L-DNA | Phosphate-ACGACGGCCAGT | MJ_1_59_LD |
| 14 | L-DNA | ACTGGCCGTCGTTCTATTGTACTCACTGTGATC | MJ_1_57_LD |
| 15 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4, polymerase Dpo4, Dpo 4 Sulfolobus solfataricus |
| 16 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 A155C, polymerase Dpo4 variant A155C |
| 17 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVICRLIRE LDIADVPGIGNITAEKLKKLGINKCCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVICLLQKILEEDERKIRRIGVRFSKFIEAIGLDKFFDT | Dpo4 V203C, polymerase Dpo4 variant V203C, |
| 18 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 A155C/V203C, polymerase Dpo4 variant A155C/V203C, |
| 19 | Protein | MIVLFVDFDYFYAQVEEVLNPSLKGKPVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S, polymerase Dpo4 variant C31S, |

TABLE 1(A)-continued

SEQUENCES REFERRED TO IN THIS APPLICATION

| SEQ ID NO: | Type | Sequence | Internal Reference |
|---|---|---|---|
| 20 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S85C, polymerase Dpo4 variant S85C |
| 21 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86C, polymerase Dpo4 variant S86C |
| 22 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYCEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S96C, polymerase Dpo4 variant S96C, |
| 23 | L-DNA | GTGGAACCGACAACTTGTGCTGCGTCCAGCATAAGAAAGGAGCTCCCTCAGAAGA AGCTGCGCAGCGTGCCAGTCTGAGCTCC | MJ_1_105_LD |
| 24 | L-DNA | TCTAATACGACTCACTATAGGAGCTCAGACTGGCACGC | MJ_oligo_187_LD |
| 25 | L-DNA | GTGGAACCGACAACTTGTGC | MJ_oligo_189_LD |
| 26 | D-DNA | ATGCTGACCCTGATTCAGGGCAAAAAAATCGTGAACCATCTGCGTAGCCGTCTGG CCTTTGAATATAACGGCCAGCTGATTAAAATTCTGAGCAAAAACATTGTGGCGGT GGGCAGCCTGCGTCGTGAAGAAAAAATGCTGAACGATGTGGATCTGCTGATTATT GTGCCGGAAAAAAAACTGCTGAAACATGTGCTGCCGAACATTCGTATTAAAGGCC TGAGCTTTAGCGTGAAAGTGTGCGGCGAACGTAAATGCGTGCTGTTTATCGAATG GGAAAAAAAAACCTACCAGCTGGACCTGTTTACCGCGCTGGCCGAAGAAAAAACC GTATGCGATCTTTCATTTTACCGGTCCGGTGAGCTATCTGATTCGTATTCGTGCGG CGCTGAAAAAAAAAACTACAAACTGAACCAGTATGGCCTGTTTAAAAAACCAGAC CCTGGTGCCGCTGAAAATTACCACCGAAAAAGAACTGATTAAAGAACTGGGCTTT ACCTATCGCATTCCGAAAAAACGCCTGTAATAA | ASFV Pol-X ORF E.coli codon optimized |
| 27 | Protein | MRGSHHHHHHGMASMTGGQQMGRDLYDDDDKDRWGSMLTLIQGKKIVNHLRSRL AFEYNGQLIKILSKNIVAVGSLRREEKMLNDVDLLIIVPEKKLLKHVLPNIRIKGLSFSV KVCGERKCVLFIEWEKKTYQLDLFTALAEEKPYAIFHFTGPVSYLIRIRAALKKKNYKL NQYGLEKNQTLVPLKITTEKELIKELGFTYRIPKKRL | His-tagged Pol-X protein sequence as encoded in pMJ14 |
| 28 | D-DNA | TCCGGTGAGCTATCTGGGTCGTATTCGTGCGGCG | QC10_up |
| 29 | D-DNA | CGCCGCACGAATACGACCCAGATAGCTCACCGGA | QC10_low |
| 30 | D-DNA | TGAGCTTTAGCGTGAAAGGGTGCGGCGAACG | QC26_up |
| 31 | D-DNA | CGTTCGCCGCACCCTTTCACGCTAAAGCTCA | QC26_low |
| 32 | D-DNA | TGAGCTTTAGCGTGAAAGCGTGCGGCGAACG | QC27_up |
| 33 | D-DNA | CGTTCGCCGCACGCTTTCACGCTAAAGCTCA | QC27_low |
| 34 | D-DNA | TGAAAGTGTGCGGCGAACGTAAAAGCGTGCTGTTTA | QC31_up |
| 35 | D-DNA | TAAACAGCACGCTTTTACGTTCGCCGCACACTTTCA | QC31_low |
| 36 | D-DNA | GATCACAGTGAGTAC | SP-1 |
| 37 | D-DNA | Phosphate-GTAAACGACGGCCAGT | D(g1)P |
| 38 | D-DNA | ACTGGCCGTCGTTTTACAGTACTCACTGTGATC | MJ_1_140_DD |
| 39 | D-DNA | ACTGGCCGTCGTTTTACCGTACTCACTGTGATC | MJ_1_141_DD |
| 40 | D-DNA | ACTGGCCGTCGTTTTACGGTACTCACTGTGATC | MJ_1_142_DD |
| 41 | D-DNA | ACTGGCCGTCGTTTTACTGTACTCACTGTGATC | SP1c + 18(g1) |
| 42 | D-DNA | Phosphate-ACGACGGCCAGT | D(g6)P |

TABLE 1(A)-continued

SEQUENCES REFERRED TO IN THIS APPLICATION

| SEQ ID NO: | Type | Sequence | Internal Reference |
|---|---|---|---|
| 43 | Protein | AcMLTLIQGKKIVNHLRSRLAFEYNGQLIKILSKNIVAVGSL-OGp | example 3 product (1) |
| 44 | Protein | H-RREEKMLNDVDLLIIVPEKKLLKHVLPNIRIKGLSFSVKA-SMe | example 3 product (2) |
| 45 | Protein | H-CGERKCVLFIEWEKKTYQLDLFTALAEEKPYAIFHFTGPVSYLIRIRAALKKKNYKL NQYGLFKNQTLVPLKITTEKELIKELGFTYRIPKKRL-OH | example 3 product (3) |
| 46 | Protein | Ac-MLTLIQGKKIVNHLRSRLAFEYNGQLIKILSKNIVAVGSLRREEKMLNDVDLLIIVPE KKLLKHVLPNIRIKGLSFSVKA-SMe | example 4 product (4) |
| 47 | D-DNA | Atto532-GGAGCTCAGACTGGCACGC | MJ_1_33_DD |
| 48 | D-DNA | GTGGAACCGACAACTTGTGCTGCGTCCAGCATAAGAAAGGAGCTCCCTCAGAAGA AGCTGCGCAGCGTGCCAGTCTGAGCTCC | MJ_1_1_DD |
| 49 | D/L-DNA | D(GG)-L(GGAGCTCAGACTGGCACGC) | MJ_1_109_MD |
| 50 | D-DNA | ATGATTGTGCTGTTTGTGGATTTTGATTATTTTTATGCCCAGGTGGAAGAAGTTCT GAATCCGAGCCTGAAAGGTAAACCGGTTGTTGTTTGTGTTTTTAGCGGTCGCTTTG AAGATAGCGGTGCAGTTGCAACCGCCAATTATGAAGCCCGTAAATTTGGTGTTAA AGCCGGTATTCCGATTGTTGAAGCCAAAAAAATTCTGCCGAATGCAGTTTATCTGC CGATGCGCAAAGAAGTTTATCAGCAGGTTAGCAGCCGTATTATGAATCTGCTGCG CGAATATAGCGAAAAAATTGAAATTGCCAGCATTGATGAAGCCTATCTGGATATT AGCGATAAAGTGCGCGATTATCGCGAAGCATATAATCTGGGCCTGGAAATTAAAA ATAAAATCCTGGAAAAAGAAAAAATTACCGTGACCGTGGGCATTAGCAAAAATA AAGTGTTTGCCAAAATTGCAGCAGATATGGCAAAACCGAATGGCATTAAAGTGAT TGATGATGAAGAAGTGAAACGTCTGATTCGCGAACTGGATATTGCAGATGTTCCG GGTATTGGCAATATTACCGCAGAAAAACTGAAAAAACTGGGCATTAATAAACTGG TTGATACCCTGAGCATTGAATTTGATAAACTGAAAGGCATGATTGGTGAAGCGAA AGCCAAAATATCTGATTAGCCTGGCACGTGATGAATATAATGAACCGATTCGTACC CGTGTTCGTAAAAGCATTGGTCGTATTGTGACCATGAAACGCAATAGCCGTAATCT GGAAGAAATTAAACCGTACCTGTTTCGTGCAATTGAAGAAAGCTATTATAAACTG GATAAACGCATTCCGAAAGCCATTCATGTTGTTGCAGTTACCGAAGATCTGGATAT TGTTAGCCGTGGTCGTACCTTTCCGCATGGTATTAGCAAAGAAACCGCCTATAGCG AAAGCGTTAAACTGCTGCAGAAAATCCTGGAAGAAGATGAACGTAAAATTCGTCG TATTGGTGTGCGCTTTAGCAAATTTATTGAAGCCATTGGCCTGGATAAATTTTTTG ATACC | Sso Dpo4 ORF E.coli codon optimized |
| 51 | Protein | MASAWSHPQFEKSGMIVLFVDFDYFYAQVEEVLNPSLKGKPVVVCVFSGRFEDSGAV ATANYEARKFGVKAGIPIVEAKKILPNAVYLPMRKEVYQQVSSRIMNLLREYSEKIEIA SIDEAYLDISDKVRDYREAYNLGLEIKNKILEKEKITVTVGISKNKVFAKIAADMAKPN GIKVIDDEEVKRLIRELDIADVPGIGNITAEKLKKLGINKLVDTLSIEFDKLKGMIGEAKA KYLISLARDEYNEPIRTRVRKSIGRIVTMKRNSRNLEEIKPYLFRAIEESYYKLDKRIPKA IHVVAVTEDLDIVSRGRTFPHGISKETAYSESVKLLQKILEEDERKIRRIGVRFSKFIEAIG LDKFFDTGS | Strep-tagged Dpo4 protein sequence as encoded in pMJ343 |
| 52 | D-DNA | CAAAAATAAAGTGTTTGCCAAAATTGCATGCGATATGGCAAAACCG AATGGCATTAAAG | QC_28_up |
| 53 | D-DNA | CTTTAATGCCATTCGGTTTTGCCATATCGCATGCAATTTTGGCAAA CACTTTATTTTTG | QC_28_low |
| 54 | D-DNA | TGAAAAACTGGGCATTAATAAACTGTGTGATACCCTGAGCATTGAATTTG | QC_29_up |
| 55 | D-DNA | CAAATTCAATGCTCAGGGTATCACACAGTTTATTAATGCCCAGTTTTTTCA | QC_29_low |
| 56 | D-DNA | TGAAAGGTAAACCGGTTGTTGTTTCTGTTTTTAGCGGTC | QC_30_up |
| 57 | D-DNA | GACCGCTAAAAACAGAAACAACAACCGGTTTACCTTTCA | QC_30_low |
| 58 | D-DNA | ATGCGCAAAGAAGTTTATCAGCAGGTTTGTAGCCGTATTATGAATC | QC_38_up |
| 59 | D-DNA | GATTCATAATACGGCTACAAACCTGCTGATAAACTTCTTTGCGCAT | QC_38_low |
| 60 | D-DNA | AAGTTTATCAGCAGGTTAGCTGTCGTATTATGAATCTGCTGCG | QC_39_up |
| 61 | D-DNA | CGCAGCAGATTCATAATACGACAGCTAACCTGCTGATAAACTT | QC_39_low |
| 62 | D-DNA | ATTATGAATCTGCTGCGCGAATATTGTGAAAAAATTGAAATTGCCAGCATT | QC_40_up |
| 63 | D-DNA | AATGCTGGCAATTTCAATTTTTTCACAATATTCGCGCAGCAGATTCATAAT | QC_40_low |

TABLE 1(A)-continued

SEQUENCES REFERRED TO IN THIS APPLICATION

| SEQ ID NO: | Type | Sequence | Internal Reference |
|---|---|---|---|
| 64 | D-DNA | Phosphate-AGCGGCTCTTCGATGATTGTGCTGTTTGTGGATTTT | MJ_1_90_DD |
| 65 | D-DNA | Phosphate-AGCGGCTCTTCGGCATGCAATTTTGGCAAACACTTT | MJ_1_91_DD |
| 66 | D-DNA | Phosphate-AGCGGCTCTTCGTGCATCACGGGAGAT | MJ_1_72_DD |
| 67 | D-DNA | Phosphate-AGCGGCTCTTCGCCCTTGAAGCTGCCACAAGGCAGGAACGTT | MJ_1_73_DD |
| 68 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIA-thioester | Dpo4 fragment 1-154 |
| 69 | D-DNA | Phosphate-AGCGGCTCTTCGATGGGAGGGAAATCAAACGGGGAA | MJ_1_99_DD |
| 70 | D-DNA | Phosphate-AGCGGCTCTTCGGCACAAAGCTTTGAAGAGCTTGTC | MJ_1_100_DD |
| 71 | D-DNA | Phosphate-AGCGGCTCTTCGTGCGATATGGCAAAACCGAATGGCATTAAA | MJ_1_96_DD |
| 72 | D-DNA | Phosphate-AGCGGCTCTTCGCCCTTAGGTATCAAAAAATTTATCCAGG | MJ_1_97_DD |
| 73 | Protein | _C_DMAKPNGIKVIDDEEVKRLIRELDIADVPGIGNITAEKLKKLGINKLVDTLSIEFDKLK GMIGEAKAKYLISLARDEYNEPIRTRVRKSIGRIVTMKRNSRNLEEIKPYLFRAIEESYY KLDKRIPKAIHVVAVTEDLDIVSRGRTFPHGISKETAYSESVKLLQKILEEDERKIRRIGV RFSKFIEAIGLDKFFDT | Dpo4 A155C fragment 155-352 |
| 74 | D-DNA | Phosphate-AGCGGCTCTTCGTGTGATACCCTGAGCATTGAATTT | MJ_1_98_DD |
| 75 | Protein | _C_DTLSIEFDKLKGMIGEAKAKYLISLARDEYNEPIRTRVRKSIGRIVTMKRNSRNLEEIK PYLFRAIEESYYKLDKRIPKAIHVVAVTEDLDIVSRGRTFPHGISKETAYSESVKLLQKIL EEDERKIRRIGVRFSKFIEAIGLDKFFDT | Dpo4 V203C fragment 203-352 |
| 76 | D-DNA | Phosphate-AGCGGCTCTTCGATGGCAGATATGGCAAAACCGAAT | MJ_1_101_DD |
| 77 | D-DNA | Phosphate-AGCGGCTCTTCGGCACAGTTTATTAATGCCCAGTTT | MJ_1_102_DD |
| 78 | Protein | ADMAKPNGIKVIDDEEVKRLIRELDIADVPGIGNITAEKLKKLGINKL-thioester | Dpo4 fragment 155-202 |
| 79 | D-DNA | TCTAATACGACTCACTATAGGAGCTCAGACTGGCACGC | DE4.40T7 |
| 80 | D-DNA | GTGGAACCGACAACTTGTGC | DE4.40R |
| 81 | Protein | H-RTFPHGISKETAYSESVKLLQKILEEDERKIRRIGVRFSKFIEAIGLDKFFDT-NH$_2$ | example 11 product(1) |
| 82 | Protein | Boc-VDTLSIEFDKLKGMIGEAKAKYLISLARDEYNEPIRTRVRKSIGRIVTMKRNSRNLE EIKPYLFRAIEESYYKLDKRIPKAIHVVAVTEDLDIVSRG-OH | example 11 product(2) |
| 83 | Protein | H-VDTLSIEFDKLKGMIGEAKAKYLISLARDEYNEPIRTRVRKSIGRIVTMKRNSRNLEE IKPYLFRAIEESYYKLDKRIPKAIHVVAVTEDLDIVSRGRTFPHGISKETAYSESVKLLQ KILEEDERKIRRIGVRFSKFIEAIGLDKFFDT-NH$_2$ | example 11 product (3) |
| 84 | Protein | Z-CDMAKPNGIKVIDDEEVKRLIRELDIADVPGIGNITAEKLKKLGINKL-benzyl-thioester | example 11 product (4) |
| 85 | Protein | H-RKEVYQQVSSRIMNLLREYSEKIEIASIDEAYLDISDKVRDYREAYNLGLEIKNKILE KEKITVTVGISKNKVFAKIA-SMe | example 11 product (7) |
| 86 | Protein | Ac-MIVLFVDFDYFYAQVEEVLNPSLKGKPVVVCVFSGRFEDSGAVATANYEARKFGV KAGIPIVEAKKILPNAVYLPM-OGp | example 11 product (6) |
| 87 | Protein | H-CDMAKPNGIKVIDDEEVKRLIRELDIADVPGIGNITAEKLKKLGINKLCDTLSIEFDKL KGMIGEAKAKYLISLARDEYNEPIRTRVRKSIGRIVTMKRNSRNLEEIKPYLFRAIEESY YKLDKRIPKAIHVVAVTEDLDIVSRGRTFPHGISKETAYSESVKLLQKILEEDERKIRRIG VRFSKFIEAIGLDKFFDT-OH | example 11 product (5) |
| 88 | Protein | Ac-MIVLFVDFDYFYAQVEEVLNPSLKGKPVVVCVFSGRFEDSGAVATANYEARKFGV KAGIPIVEAKKILPNAVYLPMRKEVYQQVSSRIMNLLREYSEKIEIASIDEAYLDISDKV RDYREAYNLGLEIKNKILEKEKITVTVGISKNKVFAKIA-SMe | example 11 product (8) |
| 89 | Protein | MIVLFVDFDYFYAQVEEVLNPSLKGKPVVVCVFSGRFEDSGAVATANYEARKFGVKA GIPIVEAKKILPN_C_VYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE | Dpo4 A71C, polymerase Dpo4 variant A71C |

TABLE 1(A)-continued

SEQUENCES REFERRED TO IN THIS APPLICATION

| SEQ ID NO: | Type | Sequence | Internal Reference |
|---|---|---|---|
| | | LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | |
| 90 | Protein | MIVLFVDFDYFYAQVEEVLNPSLKGKPVVVCVFSGRFEDSGAVATANYEARKFGVKA GIPIVEAKKILPNAVYLPGGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76G, polymerase Dpo4 variant M76G |
| 91 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76A, polymerase Dpo4 variant M76A |
| 92 | Protein | MIVLFVDFDYFYAQVEEVLNPSLKGKPVVVCVFSGRFEDSGAVATANYEARKFGVKA GIPIVEAKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 I67C, polymerase Dpo4 variant I67C |
| 93 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86G, polymerase Dpo4 variant S86G |
| 94 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 A71C/A155C/V203C, polymerase Dpo4 variant A71C/A155/V203C |
| 95 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86C/A155C/V203C, polymerase Dpo4 variant S86C/A155C/V203C, |
| 96 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKICCDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/A155C/V203C, polymerase Dpo4 variant C31S/A155C/V203C, |
| 97 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76G/A155C/V203C, polymerase Dpo4 variant M76G/A155C/V203C, |
| 98 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76A/A155C/V203C, polymerase Dpo4 variant M76A/A155C/V203C |
| 99 | Protein | MIVLFVDFDYFYAQVEEVLNPSLKGKPVVVCVFSGRFEDSGAVATANYEARKFGVKA GIPIVEAKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 I67C/A155C/V203C, polymerase Dpo4 variant I67C/A155C/V203C |

TABLE 1(A)-continued

SEQUENCES REFERRED TO IN THIS APPLICATION

| SEQ ID NO: | Type | Sequence | Internal Reference |
|---|---|---|---|
| 100 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86G/A155C/V203C, polymerase Dpo4 variant S86G/A155C/V203C |
| 101 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S96G/A155C/V203C, polymerase Dpo4 variant S96G/A155C/V203C |
| 102 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 A71C/A155C, polymerase Dpo4 variant A71C/A155C |
| 103 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86C/A155C/, polymerase Dpo4 variant S86C/A155C, |
| 104 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/A155C, polymerase Dpo4 variant C31S/A155C, |
| 105 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76G/A155C, polymerase Dpo4 variant M76G/A155C, |
| 106 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76A/A155C, polymerase Dpo4 variant M76A/A155C |
| 107 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 I67C/A155C, polymerase Dpo4 variant I67C/A155C |
| 108 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86G/A155C, polymerase Dpo4 variant S86G/A155C |
| 109 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S96G/A155C, polymerase Dpo4 variant S96G/A155C |
| 110 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI | Dpo4 A71C/V203C, polymerase Dpo4 variant A71C/V203C |

TABLE 1(A)-continued

SEQUENCES REFERRED TO IN THIS APPLICATION

| SEQ ID NO: | Type | Sequence | Internal Reference |
|---|---|---|---|
| | | RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | |
| 111 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86C/V203C, polymerase Dpo4 variant S86C/V203C, |
| 112 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/V203C, polymerase Dpo4 variant C31S/V203C, |
| 113 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76G/V203C, polymerase Dpo4 variant M76G/V203C, |
| 114 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKFFDT | Dpo4 M76A/V203C, polymerase Dpo4 variant M76A/V203C |
| 115 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 I67C/V203C, polymerase Dpo4 variant I67C/V203C |
| 116 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S86G/V203C, polymerase Dpo4 variant S86G/V203C |
| 117 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S96G/V203C, polymerase Dpo4 variant S96G/V203C |
| 118 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/A155C, polymerase Dpo4 variant C31S/A155C, |
| 119 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/V203C, polymerase Dpo4 variant C31S/V203C, |
| 120 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 C31S/A155C/V203C, polymerase Dpo4 variant C31S/A155C/V203C, |
| 121 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD | Dpo4-Δ3, polymerase Dpo4-Δ3 |

TABLE 1(A)-continued

SEQUENCES REFERRED TO IN THIS APPLICATION

| SEQ ID NO: | Type | Sequence | Internal Reference |
|---|---|---|---|
| | | YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | |
| 122 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 A155C, polymerase Dpo4-Δ3 variant A155C |
| 123 | Protein | MIVLFVDFDYFYAQVEEVLNPSLKGKPVVVCVFSGRFEDSGAVATANYEARKFGVKA<br>GIPIVEAKKILPNCVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKATHVVAVTEDLDIVS<br>RGRTFPHGISKETAYSESVKLLQKILEEDERKIRRIGVRFSKFIEAIGLDKF | Dpo4-Δ3 A71C/A155C, polymerase Dpo4-Δ3 variant A71C/A155C |
| 124 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 V203C, polymerase Dpo4-Δ3 variant V203C, |
| 125 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 A155C/V203C, polymerase Dpo4-Δ3 variant A155C/V203C, |
| 126 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 C31S, polymerase Dpo4-Δ3 variant C31S, |
| 127 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 S85C, polymerase Dpo4-Δ3 variant S85C |
| 128 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSCRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 S86C, polymerase Dpo4-Δ3 variant S86C |
| 129 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYCEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 S96C, polymerase Dpo4-Δ3 variant S96C, |
| 130 | Protein | MIVLFVDFDYFYAQVEEVLNPSLKGKPVVVCVFSGRFEDSGAVATANYEARKFGVKA<br>GIPIVEAKKILPNCVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 A71C, polymerase Dpo4-Δ3 variant A71C |
| 131 | Protein | MIVLFVDFDYFYAQVEEVLNPSLKGKPVVVCVFSGRFEDSGAVATANYEARKFGVKA<br>GIPIVEAKKILPNAVYLPGRKEVYQQVSSRIMNLLREYSEKIEIASIDEAYLDISDKVRDY<br>REAYNLGLEIKNKILEKEKITVTVGISKNKVFAKIAADMAKPNGIKVIDDEEVKRLIREL<br>DIADVPGIGNITAEKLKKLGINKLVDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEAIGLDKF | Dpo4-Δ3 M76G, polymerase Dpo4-Δ3 variant M76G |

TABLE 1(A)-continued

SEQUENCES REFERRED TO IN THIS APPLICATION

| SEQ ID NO: | Type | Sequence | Internal Reference |
|---|---|---|---|
| 132 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRESKFIEAIGLDKE | Dpo4-Δ3 M76A, polymerase Dpo4-Δ3 variant M76A |
| 133 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTEPHGISKETAYSESVKLLQKILEEDERKIRRIGVRFSKFIEAIGLDKE | Dpo4-Δ3 I67C, polymerase Dpo4-Δ3variant I67C |
| 134 | Protein | MIVLFVDFDYFYAQVEEVLNPSLKGKPVVVCVFSGRFEDSGAVATANYEARKFGVKA GIPIVEAKKILPLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S86G, polymerase Dpo4-Δ3variant S86G |
| 135 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 A71C/A155C/V203C, polymerase Dpo4-Δ3 variant A71C/A155C/V203C |
| 136 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3S86C/A155C/V203C, polymerase Dpo4-Δ3 variant S86C/A155C/V203C, |
| 137 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 C31S/A155C/V203C, polymerase Dpo4-Δ3 variant C31S/A155C/V203C, |
| 138 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKF | Dpo4-Δ3 M76G/A155C/V203C, polymerase Dpo4-Δ3 variant M76G/A155C/V203C, |
| 139 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKF | Dpo4-Δ3 M76A/A155C/V203C, polymerase Dpo4-Δ3 variant M76A/A155C/V203C |
| 140 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 I67C/A155C/V203C, polymerase Dpo4-Δ3 variant I67C/A155C/V203C |
| 141 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S86G/A155C/V203C, polymerase Dpo4-Δ3variant S86G/A155C/V203C |
| 142 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE | Dpo4-Δ3 S96G/A155C/V203C, polymerase Dpo4-Δ3 |

TABLE 1(A)-continued

SEQUENCES REFERRED TO IN THIS APPLICATION

| SEQ ID NO: | Type | Sequence | Internal Reference |
|---|---|---|---|
| | | LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | variant S96G/A155C/V203C |
| 143 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S86C/A155C, polymerase Dpo4-Δ3 variant S86C/A155C, |
| 144 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 C31S/A155C, polymerase Dpo4-Δ3 variant C31S/A155C, |
| 145 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKF | Dpo4-Δ3M76G/A155C, polymerase Dpo4-Δ3 variant M76G/A155C, |
| 146 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGLDKF | Dpo4-Δ3 M76A/A155C, polymerase Dpo4-Δ3 variant M76A/A155C |
| 147 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKE | Dpo4-Δ3 I67C/A155C, polymerase Dpo4-Δ3 variant I67C/A155C |
| 148 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S86G/A155C, polymerase Dpo4-Δ3variant S86G/A155C |
| 149 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S96G/A155C, polymerase Dpo4-Δ3 variant S96G/A155C |
| 150 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 A71C/V203C, polymerase Dpo4-Δ3variant A71C/V203C |
| 151 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 S86C/V203C, polymerase Dpo4-Δ3 variant S86C/V203C, |
| 152 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKF | Dpo4-Δ3 C31S/V203C, polymerase Dpo4-Δ3variant C31S/V203C, |

TABLE 1(A)-continued

SEQUENCES REFERRED TO IN THIS APPLICATION

| SEQ ID NO: | Type | Sequence | Internal Reference |
|---|---|---|---|
| 153 | Protein | MIVLFVDFDYFYAQVEEVLNPSLKGKPVVVCVFSGRFEDSGAVATANYEARKFGVKA<br>GIPIVEAKKILPNAVYLPGRKEVYQQVSSRIMNLLREYSEKIEIASIDEAYLDISDKVRDY<br>REAYNLGLEIKNKILEKEKITVTVGISKNKVFAKIAADMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEAIGLDKF | Dpo4-Δ3 M76G/V203C, polymerase Dpo4-Δ3variant M76G/V203C, |
| 154 | Protein | MIVLFVDFDYFYAQVEEVLNPSLKGKPVVVCVFSGRFEDSGAVATANYEARKFGVKA<br>GIPIVEAKKILPNAVYLPARKEVYQQVSSRIMNLLREYSEKIEIASIDEAYLDISDKVRDY<br>REAYNLGLEIKNKILEKEKITVTVGISKNKVFAKIAADMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEAIGLDKF | Dpo4-Δ3 M76A/V203C, polymerase Dpo4-Δ3variant M76A/V203C |
| 155 | Protein | MIVLFVDFDYFYAQVEEVLNPSLKGKPVVVCVFSGRFEDSGAVATANYEARKFGVKA<br>GIPIVEAKKCLPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 I67C/V203C, polymerase Dpo4-Δ3 variant I67C/V203C |
| 156 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSGRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 S86G/V203C, polymerase Dpo4-Δ3 variant S86G/V203C |
| 157 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYGEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 S96G/V203C, polymerase Dpo4-Δ3 variant S96G/V203C |
| 158 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 C31S/A155C, polymerase Dpo4-Δ3 variant C31S/A155C, |
| 159 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 C31S/V203C, polymerase Dpo4-Δ3 variant C31S/V203C, |
| 160 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3 C31S/A155C/V203C, polymerase Dpo4-Δ3 variant C31S/A155C/V203C, |
| 161 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6, |
| 162 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 A155C, |
| 163 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI | Dpo4-Δ6 V203C, |

TABLE 1(A)-continued

SEQUENCES REFERRED TO IN THIS APPLICATION

| SEQ ID NO: | Type | Sequence | Internal Reference |
|---|---|---|---|
| | | RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | |
| 164 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 A155C/203C, |
| 165 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 C31S, |
| 166 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S85C, |
| 167 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S86C, |
| 168 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYCEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S96C, |
| 169 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 A71C, |
| 170 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76G, |
| 171 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76A, |
| 172 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 I67C, |
| 173 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S86G, |

TABLE 1(A)-continued

SEQUENCES REFERRED TO IN THIS APPLICATION

| SEQ ID NO: | Type | Sequence | Internal Reference |
|---|---|---|---|
| 174 | Protein | MIVLFVDFDYFYAQVEEVLNPSLKGKPVVVCVFSGRFEDSGAVATANYEARKFGVKA<br>GIPIVEAKKILPNCVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 A71C/A155C/V203C, |
| 175 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSCRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S86C/A155C/V203C, |
| 176 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 C31S/A155C/V203C, |
| 177 | Protein | MIVLFVDFDYFYAQVEEVLNPSLKGKPVVVCVFSGRFEDSGAVATANYEARKFGVKA<br>GIPIVEAKKILPNAVYLPGRKEVYQQVSSRIMNLLREYSEKIEIASIDEAYLDISDKVRDY<br>REAYNLGLEIKNKILEKEKITVTVGISKNKVFAKIACDMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEAIGL | Dpo4-Δ6 M76G/A155C/V203C, |
| 178 | Protein | MIVLFVDFDYFYAQVEEVLNPSLKGKPVVVCVFSGRFEDSGAVATANYEARKFGVKA<br>GIPIVEAKKILPNAVYLPARKEVYQQVSSRIMNLLREYSEKIEIASIDEAYLDISDKVRDY<br>REAYNLGLEIKNKILEKEKITVTVGISKNKVFAKIACDMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEAIGL | Dpo4-Δ6 M76A/A155C/V203C, |
| 179 | Protein | MIVLFVDFDYFYAQVEEVLNPSLKGKPVVVCVFSGRFEDSGAVATANYEARKFGVKA<br>GIPIVEAKKCLPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 I67C/A155C/V203C, |
| 180 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSGRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S86G/A155C/V203C, |
| 181 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYGEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S96G/A155C/V203C, |
| 182 | Protein | MIVLFVDFDYFYAQVEEVLNPSLKGKPVVVCVFSGRFEDSGAVATANYEARKFGVKA<br>GIPIVEAKKILPNCVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 A71C/A155C, |
| 183 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSCRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S86C/A155C/,, |
| 184 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI | Dpo4-Δ6 C31S/A155C, |

TABLE 1(A)-continued

SEQUENCES REFERRED TO IN THIS APPLICATION

| SEQ ID NO: | Type | Sequence | Internal Reference |
|---|---|---|---|
| | | RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | |
| 185 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76G/A155C, |
| 186 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76A/A155C, |
| 187 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 I67C/A155C, |
| 188 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S86G/A155C, |
| 189 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S96G/A155C, |
| 190 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 A71C/V203C, |
| 191 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 S86C/V203C, |
| 192 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGL | Dpo4-Δ6 C31S/V203C,, |
| 193 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76G/V203C, |
| 194 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEAIGL | Dpo4-Δ6 M76A/V203C, |
| 195 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD | Dpo4-Δ6 I67C/V203C, |

TABLE 1(A)-continued

SEQUENCES REFERRED TO IN THIS APPLICATION

| SEQ ID NO: | Type | Sequence | Internal Reference |
|---|---|---|---|
| | | YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | |
| 196 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSGRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S86G/V203C, |
| 197 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYGEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 S96G/V203C, |
| 198 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 C31S/A155C, |
| 199 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 C31S/V203C, |
| 200 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6 C31S/A155C/V203C, |
| 201 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9, |
| 202 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9 A155C, |
| 203 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9 V203C, |
| 204 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9 A155C/V203C, |
| 205 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9 C31S, |

TABLE 1(A)-continued

SEQUENCES REFERRED TO IN THIS APPLICATION

| SEQ ID NO: | Type | Sequence | Internal Reference |
|---|---|---|---|
| 206 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S85C, |
| 207 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S86C, |
| 208 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYCEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S96C, |
| 209 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 A71C, |
| 210 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76G, |
| 211 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76A, |
| 212 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 I67C, |
| 213 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S86G, |
| 214 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 A71C/A155C/V203C, |
| 215 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S86C/A155C/V203C, |
| 216 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE | Dpo4-Δ9 C31S/A155C/V203C, |

TABLE 1(A)-continued

SEQUENCES REFERRED TO IN THIS APPLICATION

| SEQ ID NO: | Type | Sequence | Internal Reference |
|---|---|---|---|
|  |  | LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA |  |
| 217 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76G/A155C/V203C, |
| 218 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76A/A155C/V203C, |
| 219 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 167C/A155C/V203C, |
| 220 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S86G/A155C/V203C, |
| 221 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S96G/A155C/V203C, |
| 222 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 A71C/A155C, |
| 223 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 S86C/A155C/,, |
| 224 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 C31S/A155C, |
| 225 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76G/A155C, |
| 226 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKFIEA | Dpo4-Δ9 M76A/A155C, |

TABLE 1(A)-continued

SEQUENCES REFERRED TO IN THIS APPLICATION

| SEQ ID NO: | Type | Sequence | Internal Reference |
|---|---|---|---|
| 227 | Protein | MIVLFVDFDYFYAQVEEVLNPSLKGKPVVVCVFSGRFEDSGAVATANYEARKFGVKA<br>GIPIVEAKKCLPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>I67C/A155C, |
| 228 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S86G/A155C, |
| 229 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYGEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S96G/A155C, |
| 230 | Protein | MIVLFVDFDYFYAQVEEVLNPSLKGKPVVVCVFSGRFEDSGAVATANYEARKFGVKA<br>GIPIVEAKKILPNCVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>A71C/V203C, |
| 231 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSCRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S86C/V203C, |
| 232 | Protein | MIVLFVDFDYFYAQVEEVLNPSLKGKPVVVSVFSGRFEDSGAVATANYEARKFGVKA<br>GIPIVEAKKILPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>C31S/V203C,, |
| 233 | Protein | MIVLFVDFDYFYAQVEEVLNPSLKGKPVVVCVFSGRFEDSGAVATANYEARKFGVKA<br>GIPIVEAKKILPNAVYLPGRKEVYQQVSSRIMNLLREYSEKIEIASIDEAYLDISDKVRDY<br>REAYNLGLEIKNKILEKEKITVTVGISKNKVFAKIAADMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEA | Dpo4-Δ9<br>M76G/V203C, |
| 234 | Protein | MIVLFVDFDYFYAQVEEVLNPSLKGKPVVVCVFSGRFEDSGAVATANYEARKFGVKA<br>GIPIVEAKKILPNAVYLPARKEVYQQVSSRIMNLLREYSEKIEIASIDEAYLDISDKVRDY<br>REAYNLGLEIKNKILEKEKITVTVGISKNKVFAKIAADMAKPNGIKVIDDEEVKRLIREL<br>DIADVPGIGNITAEKLKKLGINKLCDTLSIEFDKLKGMIGEAKAKYLISLARDEYNEPIR<br>TRVRKSIGRIVTMKRNSRNLEEIKPYLFRAIEESYYKLDKRIPKAIHVVAVTEDLDIVSR<br>GRTFPHGISKETAYSESVKLLQKILEEDERKIRRIGVRFSKFIEA | Dpo4-Δ9<br>M76A/V203C, |
| 235 | Protein | MIVLFVDFDYFYAQVEEVLNPSLKGKPVVVCVFSGRFEDSGAVATANYEARKFGVKA<br>GIPIVEAKKCLPNAVYLPMRKEVYQQVSSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>I67C/V203C, |
| 236 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSGRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S86G/V203C, |
| 237 | Protein | MIVLFVDFDYFYAQVEEVLNPSLKGKPVVVCVFSGRFEDSGAVATANYEARKFGVKA<br>GIPIVEAKKILPNAVYLPMRKEVYQQVSSRIMNLLREYGEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI | Dpo4-Δ9<br>S96G/V203C, |

TABLE 1(A)-continued

SEQUENCES REFERRED TO IN THIS APPLICATION

| SEQ ID NO: | Type | Sequence | Internal Reference |
|---|---|---|---|
| | | RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | |
| 238 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 C31S/A155C, |
| 239 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 C31S/V203C, |
| 240 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEA | Dpo4-Δ9 C31S/A155C/V203C, |
| 241 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12, |
| 242 | Protein | MIVLFVDFDYFYAQVEEVLNPSLKGKPVVVCVFSGRFEDSGAVATANYEARKFGVKA GIPIVEAKIULPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A155C, |
| 243 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 V203C, |
| 244 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A155C/V203C, |
| 245 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S, |
| 246 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S85C, |
| 247 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86C, |
| 248 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYCEKIEIASIDEAYLDISDKVRD | Dpo4-Δ12 S96C, |

TABLE 1(A)-continued

SEQUENCES REFERRED TO IN THIS APPLICATION

| SEQ ID NO: | Type | Sequence | Internal Reference |
|---|---|---|---|
| | | YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | |
| 249 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A71C, |
| 250 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76G, |
| 251 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76A, |
| 252 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 I67C, |
| 253 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86G, |
| 254 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A71C/A155C/V203C, |
| 255 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86C/A155C/V203C, |
| 256 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/A155C/V203C, |
| 257 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76G/A155C/V203C, |
| 258 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76A/A155C/V203C, |

TABLE 1(A)-continued

SEQUENCES REFERRED TO IN THIS APPLICATION

| SEQ ID NO: | Type | Sequence | Internal Reference |
|---|---|---|---|
| 259 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 I67C/A155C/V203C, |
| 260 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86G/A155C/V203C, |
| 261 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S96G/A155C/V203C, |
| 262 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A71C/A155C, |
| 263 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86C/A155C/,, |
| 264 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/A155C, |
| 265 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76G/A155C, |
| 266 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76A/A155C, |
| 267 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 I67C/A155C, |
| 268 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86G/A155C, |
| 269 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE | Dpo4-Δ12 S96G/A155C, |

TABLE 1(A)-continued

SEQUENCES REFERRED TO IN THIS APPLICATION

| SEQ ID NO: | Type | Sequence | Internal Reference |
|---|---|---|---|
| | | LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | |
| 270 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 A71C/V203C, |
| 271 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86C/V203C, |
| 272 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/V203C, |
| 273 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76G/V203C, |
| 274 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRFSKF | Dpo4-Δ12 M76A/V203C, |
| 275 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 I67C/V203C, |
| 276 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S86G/V203C, |
| 277 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S96G/V203C, |
| 278 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/A155C, |
| 279 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/V203C, |

TABLE 1(A)-continued

SEQUENCES REFERRED TO IN THIS APPLICATION

| SEQ ID NO: | Type | Sequence | Internal Reference |
|---|---|---|---|
| 280 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 C31S/A155C/V203C, |
| 281 | Protein | MIVLFVDFDYFYAQVEEVLNPSLKGKPVVVSVFSGRFEDSGAVATANYEARKFGVKA GIPIVEAKIULPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15, |
| 282 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A155C, |
| 283 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 V203C, |
| 284 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A155C/V203C, |
| 285 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S, |
| 286 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S85C, |
| 287 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86C, |
| 288 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYCEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S96C, |
| 289 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A71C, |
| 290 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL | Dpo4-Δ15 M76G, |

TABLE 1(A)-continued

SEQUENCES REFERRED TO IN THIS APPLICATION

| SEQ ID NO: | Type | Sequence | Internal Reference |
|---|---|---|---|
| | | DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | |
| 291 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76A, |
| 292 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 I67C, |
| 293 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86G, |
| 294 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A71C/A155C/V203C, |
| 295 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86C/A155C/V203C, |
| 296 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/A155C/V203C, |
| 297 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76G/A155C/V203C, |
| 298 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76A/A155C/V203C, |
| 299 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 I67C/A155C/V203C, |
| 300 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86G/A155C/V203C, |

TABLE 1(A)-continued

SEQUENCES REFERRED TO IN THIS APPLICATION

| SEQ ID NO: | Type | Sequence | Internal Reference |
|---|---|---|---|
| 301 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S96G/A155C/V203C, |
| 302 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A71C/A155C, |
| 303 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86C/A155C/,, |
| 304 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/A155C, |
| 305 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76G/A155C, |
| 306 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIACDMAKPNGIKVIDDEEVKRLIREL DIADVPGIGNITAEKLKKLGINKLVDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76A/A155C, |
| 307 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 I67C/A155C, |
| 308 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86G/A155C, |
| 309 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S96G/A155C, |
| 310 | Protein | MIVLFVDFDYFYAQVEEVLNPSLKGKPVVVCVFSGRFEDSGAVATANYEARKFGVKA GIPIVEAKKILPNCVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 A71C/V203C, |
| 311 | Protein | MIVLFVDFDYFYAQVEEVLNPSLKGKPVVVCVFSGRFEDSGAVATANYEARKFGVKA GIPIVEAKKILPNAVYLPMRKEVYQQVSCRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI | Dpo4-Δ15 S86C/V203C, |

TABLE 1(A)-continued

SEQUENCES REFERRED TO IN THIS APPLICATION

| SEQ ID NO: | Type | Sequence | Internal Reference |
|---|---|---|---|
| | | RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | |
| 312 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/V203C,, |
| 313 | Protein | MIVLFVDFDYFYAQVEEVLNPSLKGKPVVVCVFSGRFEDSGAVATANYEARKFGVKA GIPIVEAKKILPNAVYLPGRKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76G/V203C, |
| 314 | Protein | MIVLFVDFDYFYAQVEEVLNPSLKGKPVVVCVFSGRFEDSGAVATANYEARKFGVKA GIPIVEAKKILPNAVYLPARKEVYQQVSSRIMNLLREYSEKIEIASIDEAYLDISDKVRDY REAYNLGLEIKNKILEKEKITVTVGISKNKVFAKIAADMAKPNGIKVIDDEEVKRLIREL DIADVPGIGNITAEKLKKLGINKLCDTLSIEFDKLKGMIGEAKAKYLISLARDEYNEPIR TRVRKSIGRIVTMKRNSRNLEEIKPYLFRAIEESYYKLDKRIPKAIHVVAVTEDLDIVSR GRTFPHGISKETAYSESVKLLQKILEEDERKIRRIGVRF | Dpo4-Δ15 M76A/V203C, |
| 315 | Protein | MIVLFVDFDYFYAQVEEVLNPSLKGKPVVVCVFSGRFEDSGAVATANYEARKFGVKA GIPIVEAKKCLPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 I67C/V203C, |
| 316 | Protein | MIVLFVDFDYFYAQVEEVLNPSLKGKPVVVCVFSGRFEDSGAVATANYEARKFGVKA GIPIVEAKKILPNAVYLPMRKEVYQQVSGRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S86G/V203C, |
| 317 | Protein | MIVLFVDFDYFYAQVEEVLNPSLKGKPVVVCVFSGRFEDSGAVATANYEARKFGVKA GIPIVEAKKILPNAVYLPMRKEVYQQVSSRIMNLLREYGEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S96G/V203C, |
| 318 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/A155C, |
| 319 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKLCDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/V203C, |
| 320 | Protein | MIVLFVDFDYFYAQVEEVLNPSLKGKPVVVSVFSGRFEDSGAVATANYEARKFGVKA GIPIVEAKKILPNAVYLPMRKEVYQQVSSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 C31S/A155C/V203C, |
| 321 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD YREAYNLGLEIKNKILEKEKITVTVGISKNKVFAKIACDMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKFIEAIGLDKFFDT | Dpo4 S85C/A155C |
| 322 | Protein | MIVLFVDFDYFYAQVEEVLNPSLKGKPVVVCVFSGRFEDSGAVATANYEARKFGVKA GIPIVEAKKILPNAVYLPMRKEVYQQVCSRIMNLLREYSEKIEIASIDEAYLDISDKVRD | Dpo4 S85C/V203C |

TABLE 1(A)-continued

SEQUENCES REFERRED TO IN THIS APPLICATION

| SEQ ID NO: | Type | Sequence | Internal Reference |
|---|---|---|---|
| | | YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKFFDT | |
| 323 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKFFDT | Dpo4<br>S85C/A155C/V203C |
| 324 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3<br>S85C/A155C |
| 325 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3<br>S85C/V203C |
| 326 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGLDKF | Dpo4-Δ3<br>S85C/A155C/V203C |
| 327 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6<br>S85C/A155C |
| 328 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6<br>S85C/V203C |
| 329 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEAIGL | Dpo4-Δ6<br>S85C/A155C/V203C |
| 330 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIACDMAKPNGIKVIDDEEVKRLIRE<br>LDIADVPGIGNITAEKLKKLGINKLVDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S85C/A155C |
| 331 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKIAADMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S85C/V203C |
| 332 | Protein | MIVLFVDFDYFYAQVEEVLNPSLKGKPVVVCVFSGRFEDSGAVATANYEARKFGVKA<br>GIPIVEAKKILPNAVYLPMRKEVYQQVCSRIMNLLREYSEKIEIASIDEAYLDISDKVRD<br>YREAYNLGLEIKNKILEKEKITVTVGISKNKVFAKICCDMAKPNGIKVIDDEEVKRLIRE<br>LDIADVPGIGNITAEKLKKLGINKLCDTLSIEFDKLKGMIGEAKAKYLISLARDEYNEPI<br>RTRVRKSIGRIVTMKRNSRNLEEIKPYLFRAIEESYYKLDKRIPKAIHVVAVTEDLDIVS<br>RGRTFPHGISKETAYSESVKLLQKILEEDERKIRRIGVRFSKFIEA | Dpo4-Δ9<br>S85C/A155C/V203C |

TABLE 1(A)-continued

SEQUENCES REFERRED TO IN THIS APPLICATION

| SEQ ID NO: | Type | Sequence | Internal Reference |
|---|---|---|---|
| 333 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIA*C*DMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S85C/A155C |
| 334 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKL*C*DTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S85C/V203C |
| 335 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIA*C*DMAKPNGIKVIDDEEVKRLIRE LDIADVPGIGNITAEKLKKLGINKL*C*DTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRFSKF | Dpo4-Δ12 S85C/A155C/V203C |
| 336 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIA*C*DMAKPNGIKVIDDEEVKRLIRE LDIADVPGIGNITAEKLKKLGINKLVDTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S85C/A155C |
| 337 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIAADMAKPNGIKVIDDEEVKRLIRE LDIADVPGIGNITAEKLKKLGINKL*C*DTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S85C/V203C |
| 338 | Protein | MIVLFVDFDYFYAQVEEVLNPSLKGKPVVVCVFSGRFEDSGAVATANYEARKFGVKA GIPIVEAKKILPNAVYLPMRKEVYQQV*C*SRIMNLLREYSEKIEIASIDEAYLDISDKVRD YREAYNLGLEIKNKILEKEKITVTVGISKNKVFAKIA*C*DMAKPNGIKVIDDEEVKRLIRE LDIADVPGIGNITAEKLKKLGINKL*C*DTLSIEFDKLKGMIGEAKAKYLISLARDEYNEPI RTRVRKSIGRIVTMKRNSRNLEEIKPYLFRAIEESYYKLDKRIPKAIHVVAVTEDLDIVS RGRTFPHGISKETAYSESVKLLQKILEEDERKIRRIGVRF | Dpo4-Δ15 S85C/A155C/V203C |
| 339 | Protein | MIILFVDFDYFYAQVEEVLNPSLKGKPVVVCVFSGRFEDSGAVATANYEARKFGIKAG ISIVEAKKILPNAVYLPMRKEVYQQVSNRIMKLLREYSEKIEIASIDEAYLDISDKVKNY QDAYNLGLEIKNKILEKEKITVTVGISKNKVFAKIAADMAKPNGIKVIDDEEVKRLIVEL DIADIPGIGDITAEKLKKLGVNKLVDTLRIEFDELKGIIGEAKAKYLFSLARDEYNEPIRA RVRKSIGRIVTMKRNSRDLEEIKPYLFRAIEEAYYKLDKKIPKAIHVVAVTEDLDIVSRG RTFTHGISKETAYREAVRLLQKILEEDERKIRRIGVRFSKFIEAIGLDKFFDT | Dpo 4 Sulfolobus islandicus |
| 340 | Protein | MIILFVDFDYFYAQVEEVLDTSLKGKPVVVCVFSGRFEDSGAVATANYEARKFGIKAG IPIVEAKKILPNAVYLPMRKEVYQQVSNRIMRLLREYSEKIEIASIDEAYLDISDKVKDY QEAYNLGLEIKNKILEKEKITVTVGISKNKVFAKIAADMAKPNGIKVIDNDEVKRLIREL DIGDVPGVGSITAEKLKKLGVNKLVDTLRVEFGELKRIIGEAKAKYLYSLARDEYNEPI RARVRKSIGRIVTMKRNSRDLEEIKPYLFRAIEEAYHKLDKKIPKAIHVVAITEDLDIVS RGRTFTHGISKETAYKEAVKLLQKILEEDERKIRRIGVRFSKFIEAIGLDRFFNT | Dpo 4 Sulfolobus shibatae |
| 341 | Protein | MIILFVDFDYFYAQVEEVLNPSLKGKPVVVCVFSGRTENSGAVATANYEARKLGVKA GMPIVKAKEILPDAIYLPMRKEVYQQVSNRIMNILRKYSRKIEIASIDEAYLDISDKVNN YTDAYKIGLQIKNEIYEKEKITVTVGISKNKVFAKIAAEMAKPNGIKVIDDNEVKKLIRE IDIGEIPGVGEITTQKLKSLGINKLIDILNFDFMKIKKIVGEAKANYLFSLARDEYFGPVK ERVRKSIGRIVTLKKNSRNIEEIKPFLARSLDEAFNKLNGKIPKTIYLVAVMEDLDIISRG KTFPHGITKETAYKASLELLEKLLAEDKRKIRRIGVRFSKFIEATSLDKFFQF | Dpo 4 Sulfolobus tengchongensis |
| 342 | Protein | MIILFVDFDYFFAQVEEVLNPQYKGKPLIVCVYSGRNEKSGAVATANYEARKLGVKA GMPISRAMELAPNAIFVPMHKEVYTEVSNRIMSIISSYSDKIEIASIDEAYIDITSKVKNFE EAIELGKKLKREIMEKEKITVTVGIAPNKVFAKIIADRVKPNGLGVVKPEEIEEFIKSIDI DEVPGVGNVISERLHSLGVNKLIDILSVSFDKLKEEIGEAKAFYLRLATNSYFEPVLNK ERVPHGRYLTLPKNTRDIKVIELYLKKAIDEAYNKIEGIPKRMTVVTIMQDLDIVSKSK TFKTGISKERAYTESIELLKQILQKDSRLVRRVGVRFDNIYKSKGLDVFFNS | Dpo 4 Sulfolobus tokodaii |
| 343 | Protein | MIVIFVDFDYFFAQVEEVLNPQYKGKPLVVCVYSGRTKTSGAVATANYEARKLGVKA GMPIIKAMQIAPSAIYVPMRKPIYEAFSNRIMNLLNKHADKIEVASIDEAYLDVTNKVE GNFENGIELARKIKQEILEKEKITVTVGVAPNKILAKIIADKSKPNGLGVIRPTEVQDFLN | Dpo 4 Sulfolobus acidocaldarius |

TABLE 1(A)-continued

SEQUENCES REFERRED TO IN THIS APPLICATION

| SEQ ID NO: | Type | Sequence | Internal Reference |
|---|---|---|---|
| | | ELDIDEIPGIGSVLARRLNELGIQKLRDILSKNYNELEKITGKAKALYLLKLAQNKYSEP VENKSKIPHGRYLTLPYNTRDVKVILPYLKKAINEAYNKVNGIPMRITVIAIMEDLDILS KGKKFKHGISIDNAYKVAEDLLRELLVRDKRRNVRRIGVKLDNIIINKTNLSDFFDI | |

It will be understood that the above is a representation of the molecules as they were used in connection with the instant invention. The attached sequence listing does only reflect the mere amino acid or nucleotide sequence thereof and not any further feature of said molecules as indicated in the above table.

The present invention is further illustrated by the figures, examples and the sequence listing from which further features, embodiments and advantages may be taken, wherein FIG. 1A shows composition of 1-gap D-DNA templates for activity test of L-polymerase X;

FIG. 1B shows composition of 6-gap D-DNA templates for activity test of L-polymerase X;

FIG. 2A-B shows analytics of synthesized D-polypeptide product Ac-MLTLIQGKKIVNHLRSRLAFEYNGQLIKIL-SKNIVAVGSL-OGp (1) (SEQ ID NO: 43) by UPLC (A) and mass spectrometry (B);

FIG. 3 A-B shows analytics of synthesized D-polypeptide product H-RREEKMLNDVDLLIIV-PEKKLLKHVLPNIRIKGLSFSVKA-SMe (2) (SEQ ID NO: 44) by UPLC (A) and mass spectrometry (B);

FIG. 4 A-B shows analytics of synthesized D-polypeptide product H-CGERKCVLFIEWEKKTYQLDLFTA-LAEEKPYAIFHFTGPV SYLIRIRAALKK-KNYKLNQYGLFKNQTLVPLKITTEKELI KELGFTYR-IPKKRL-OH (SEQ ID NO: 45) (3) by UPLC (A) and mass spectrometry (B);

FIG. 5 A-B shows analytics of synthesized D-polypeptide product Ac-MLTLIQGKKIVNHLRSRLAFEYNGQLIKIL-SKNIVAVGSLRREEK MLNDVDLLIIV-PEKKLLKHVLPNIRIKGLSFSVKA-SMe (4) (SEQ ID NO: 46) by UPLC (A) and mass spectrometry (B);

FIG. 6 A-B shows analytics of native chemical ligation D-polypeptide product Ac-MLTLIQGKKIVNHLRSR-LAFEYNGQLIKILSKNIVAVGSLRREEK MLNDVDL-LIIVPEKKLLKHVLPNIRIKGLSFSVKACGERKCVLFIE WEKKTYQLDLFTALAEEKPYAIFHFTGPVSYLIRI-RAALKKKNY KLNQYGLFKNQTLVPLKITTEKE-LIKELGFTYRIPKKRL-OH (5) (SEQ ID NO: 1) by SDS-PAGE (A) and mass spectrometry (B);

FIG. 7 shows composition of 1-gap L-DNA templates for activity test of D-polymerase X;

FIG. 9A shows composition of 6-gap L-DNA templates for activity test of D-polymerase X;

FIG. 9B shows gel electrophoresis of L-DNA elongation activity assay of D-polymerase X on 6-gap substrate;

Figure 13:
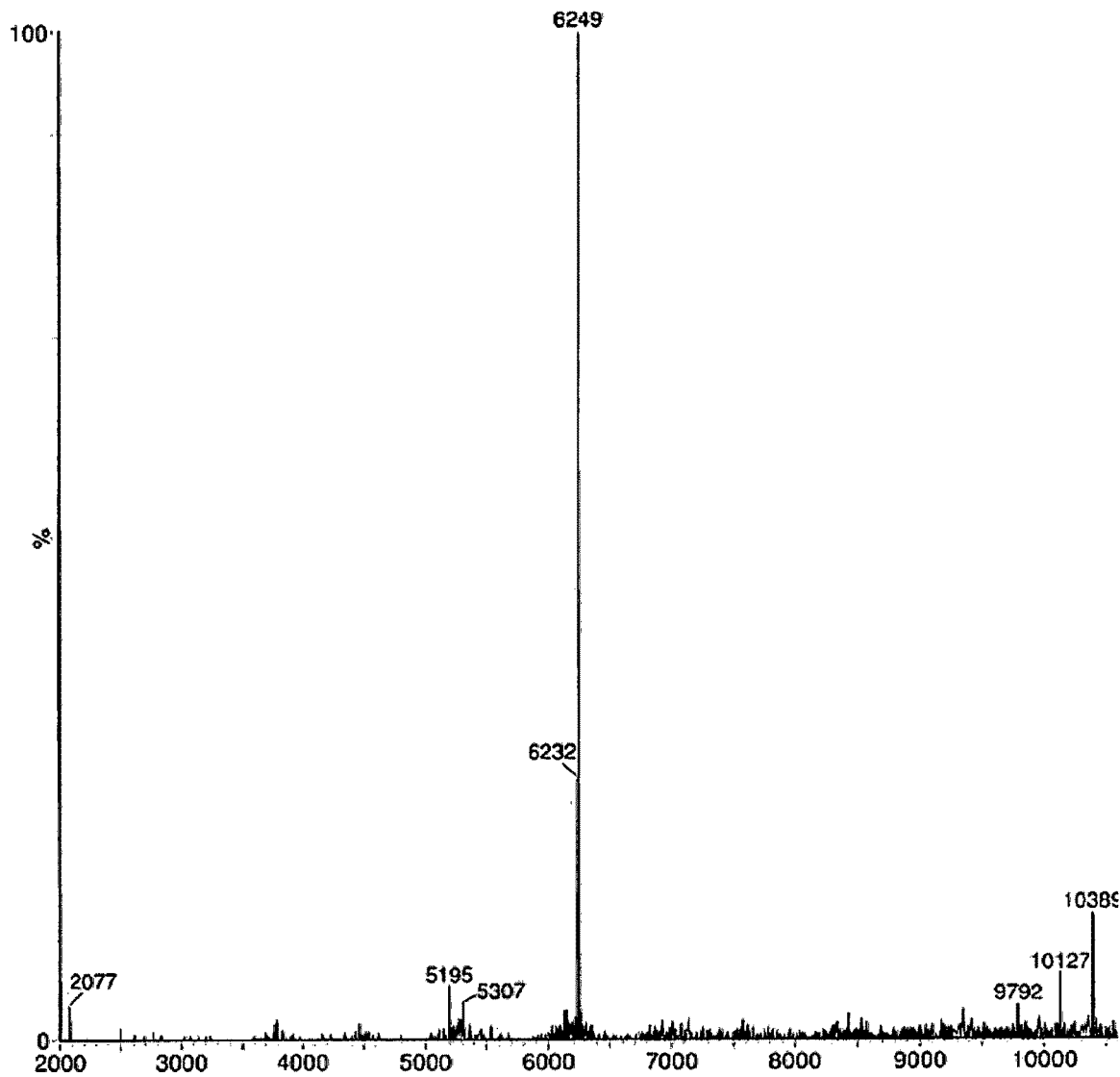
Figure 14:
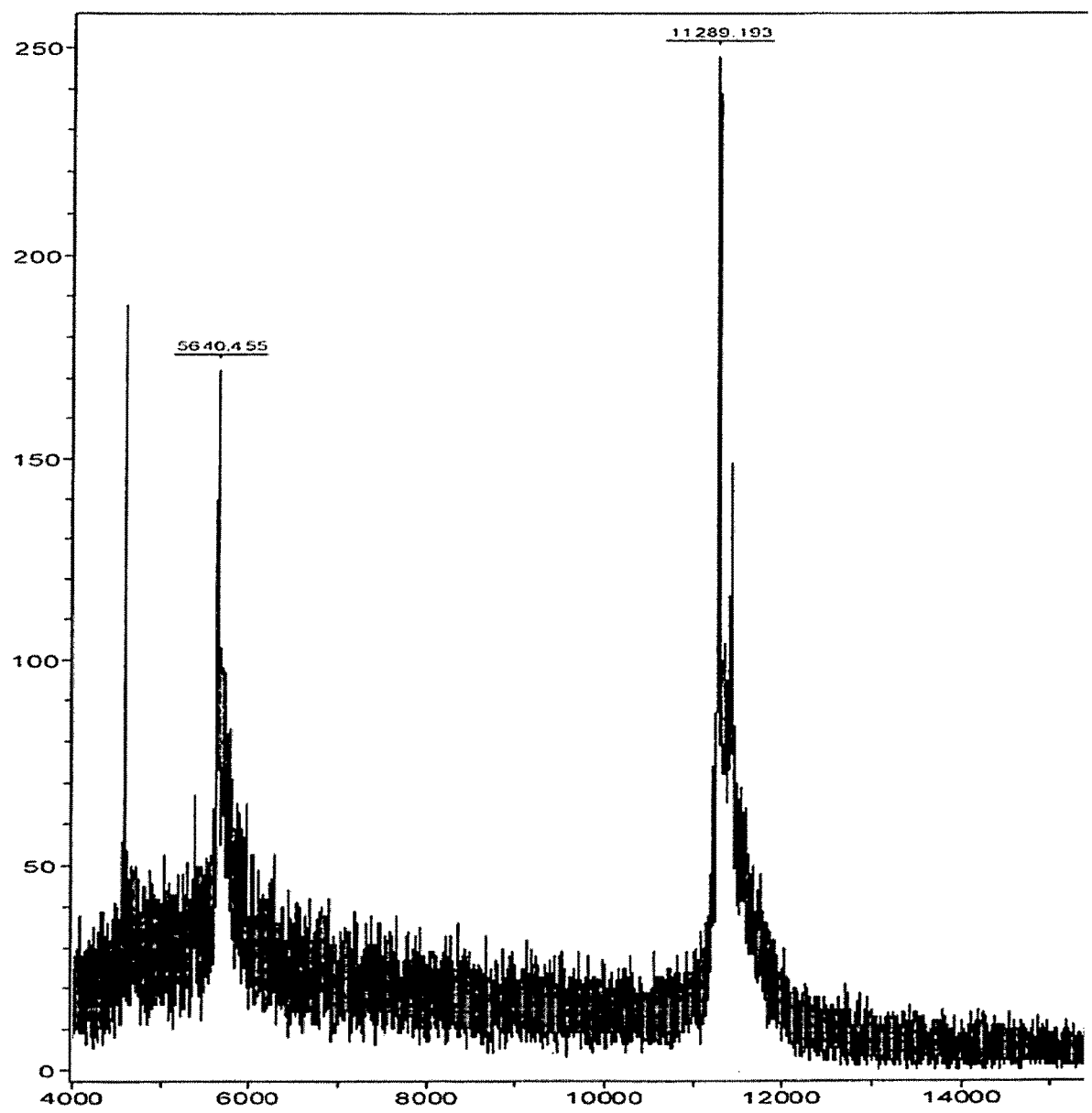
Figure 15:
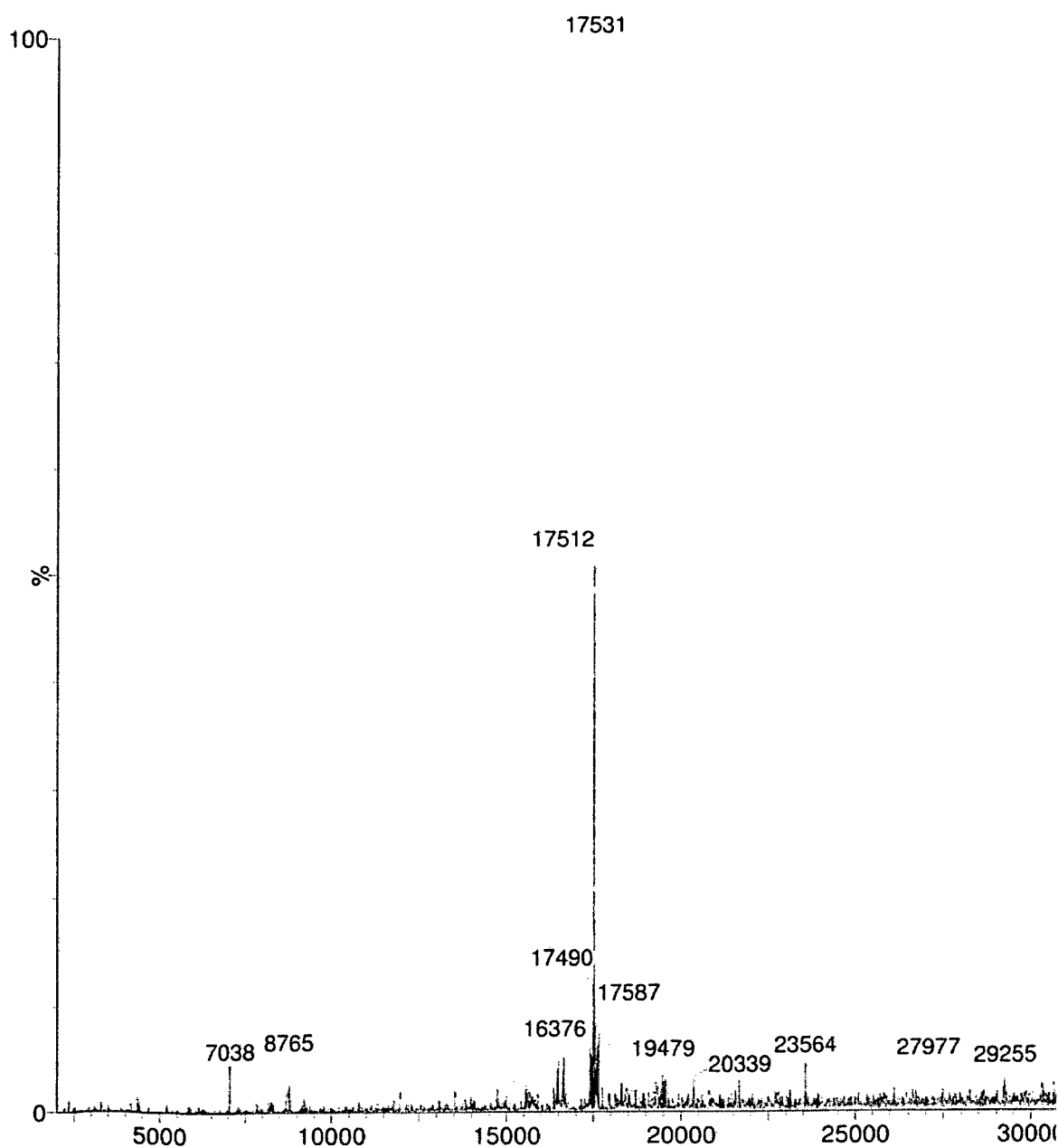
Figure 19:
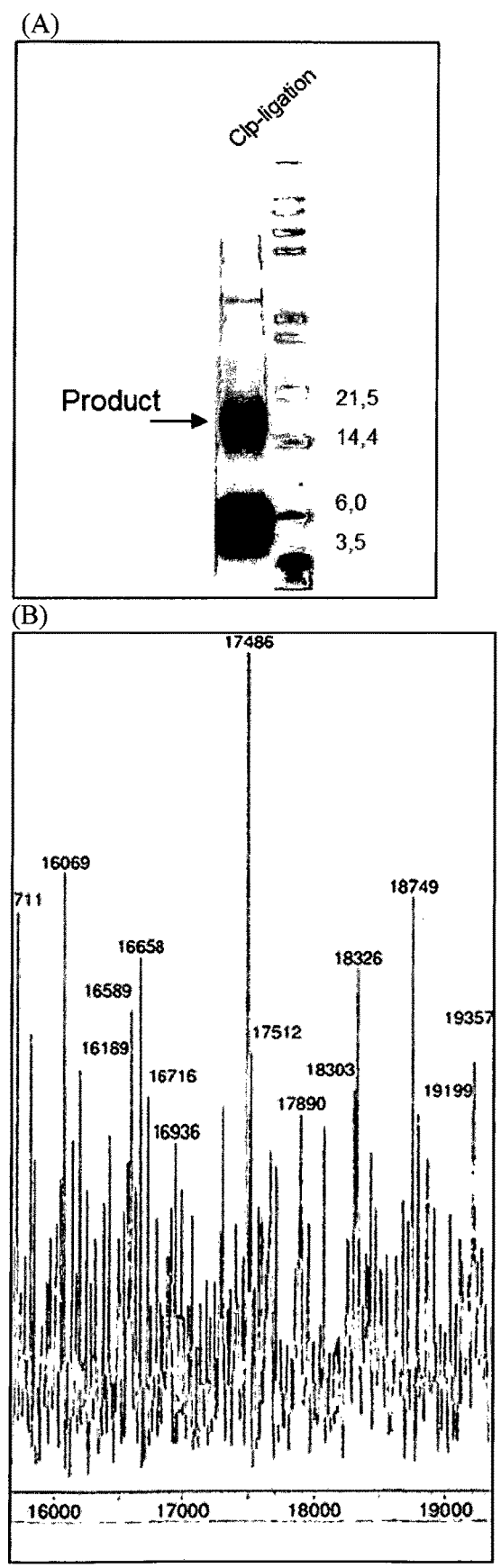
Figure 20:
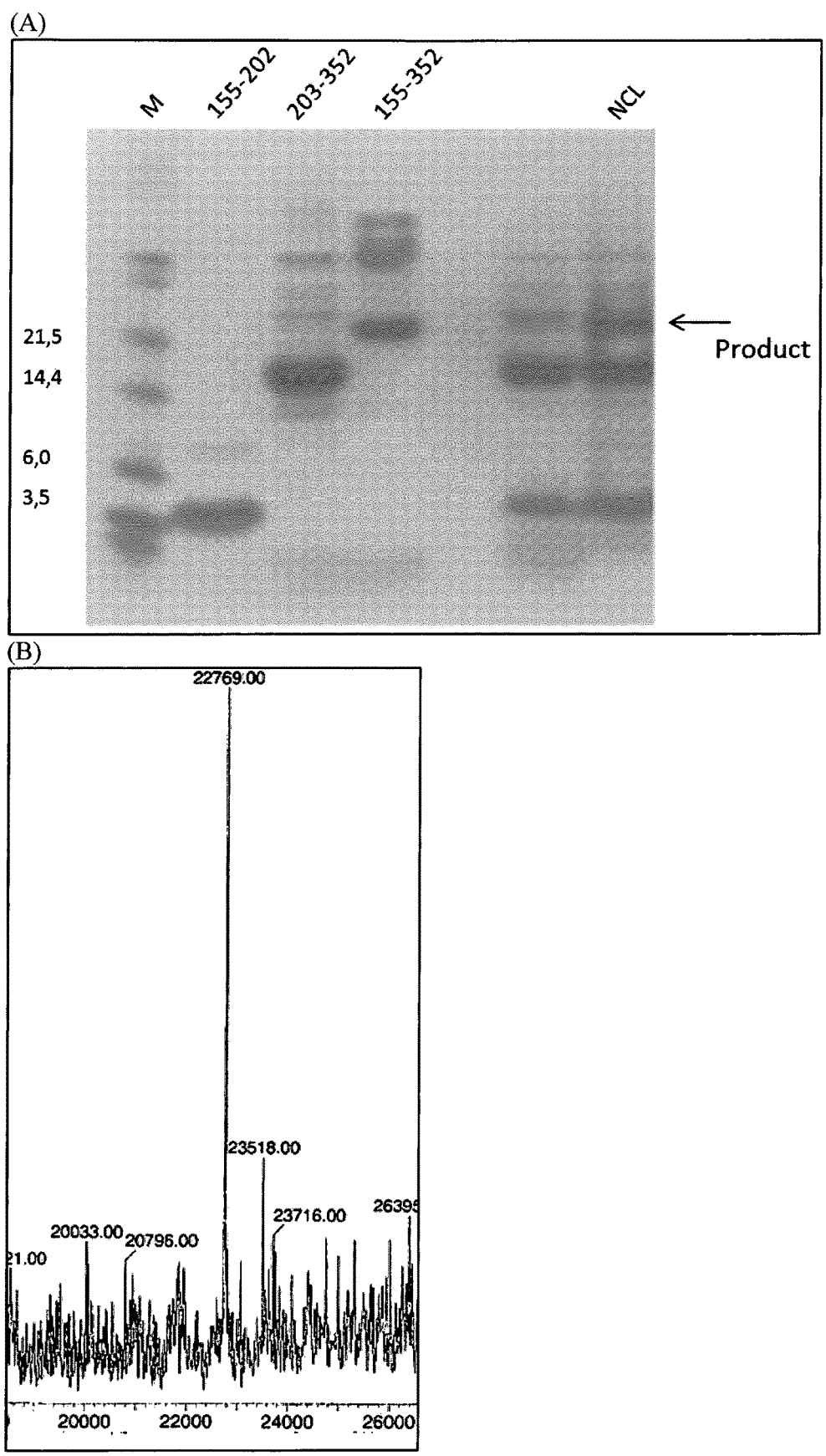
Figure 21:
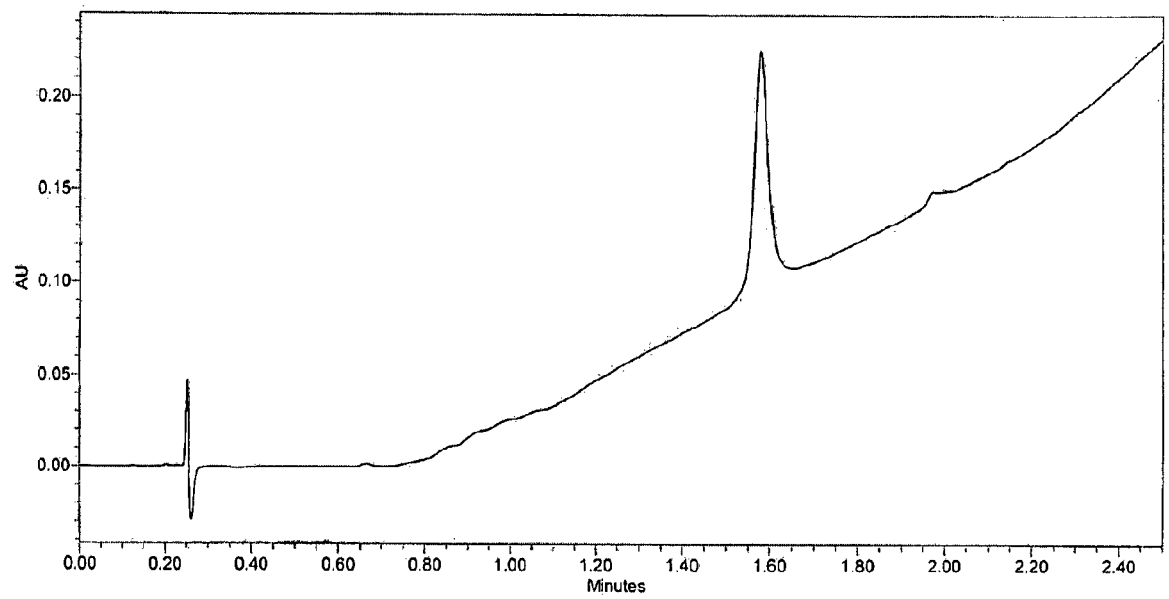
Figure 22:
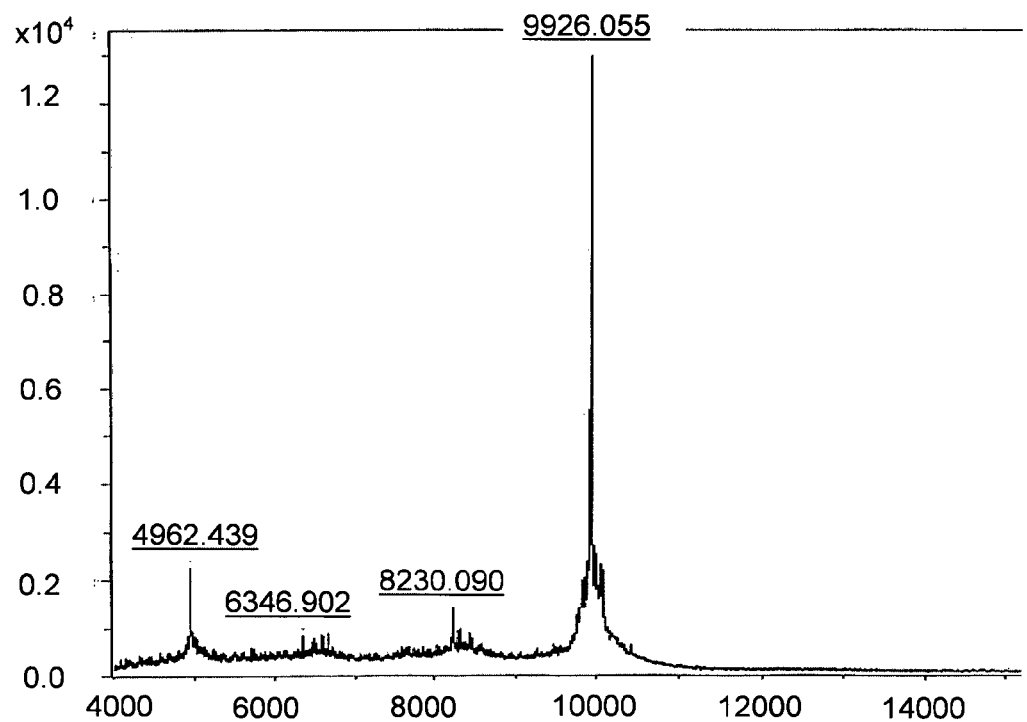
Figure 23:
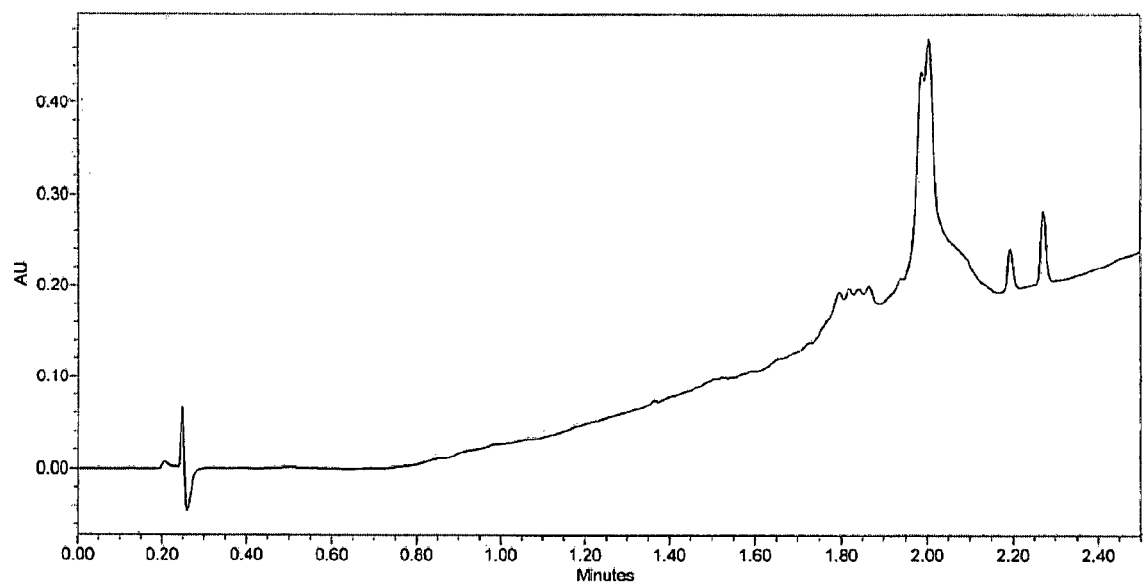
Figure 24:
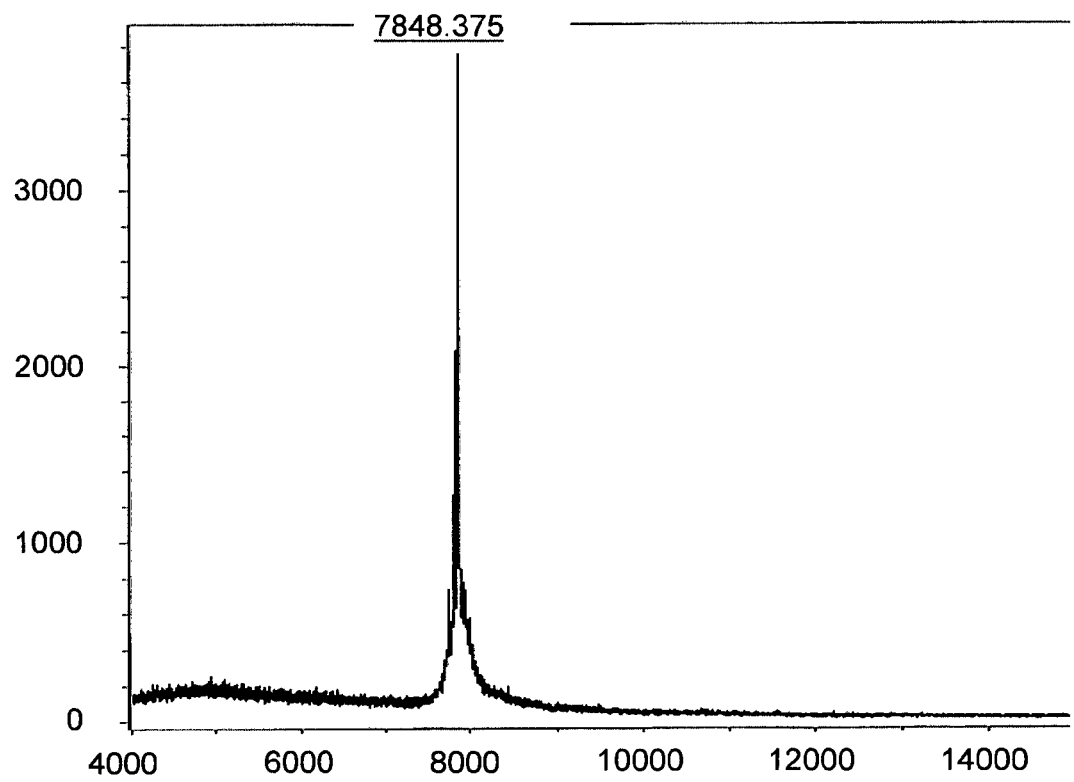
Figure 26:
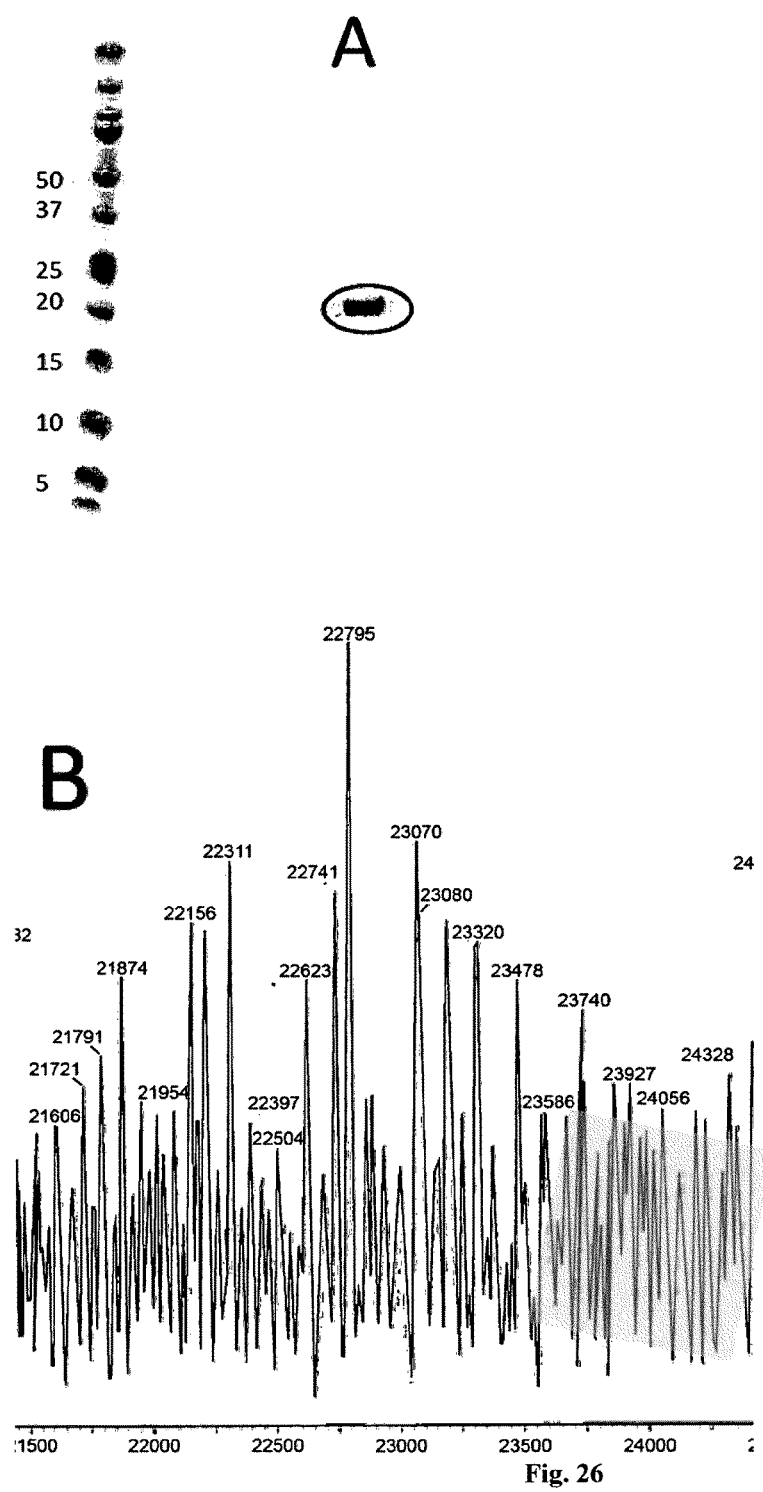
Figure 27:
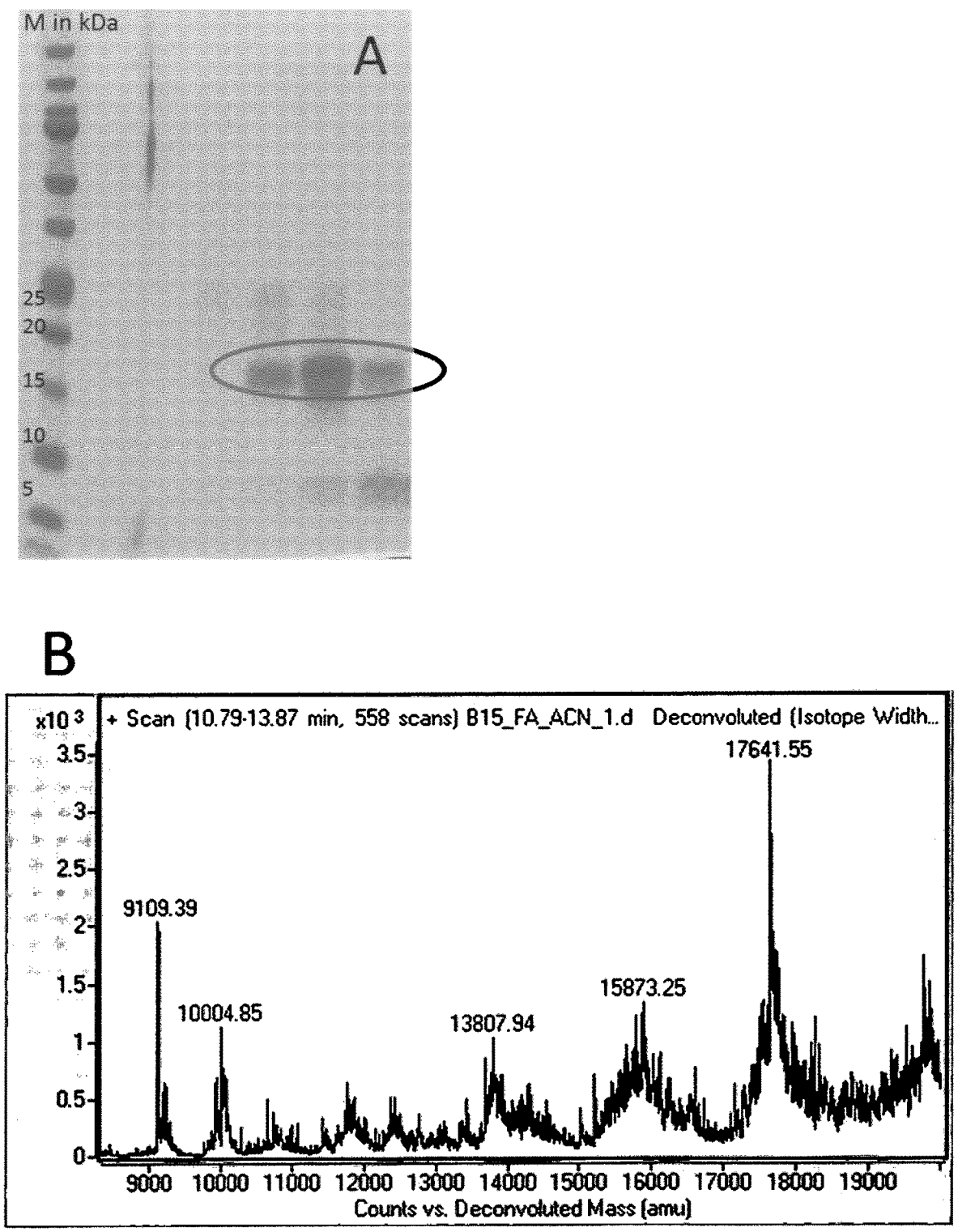
Figure 29:
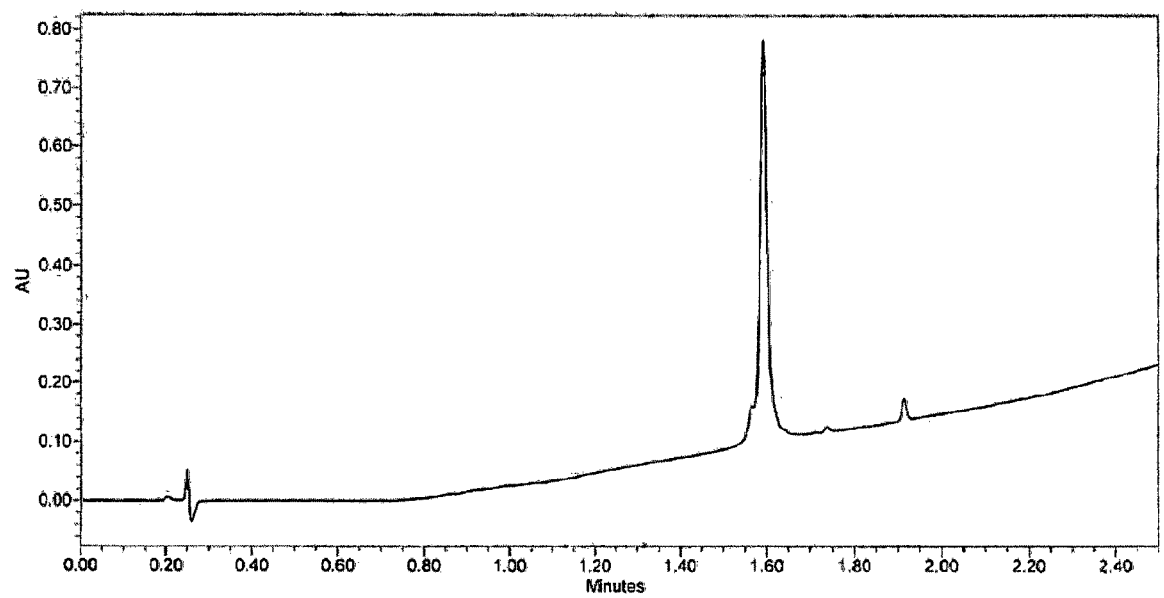
Figure 30:
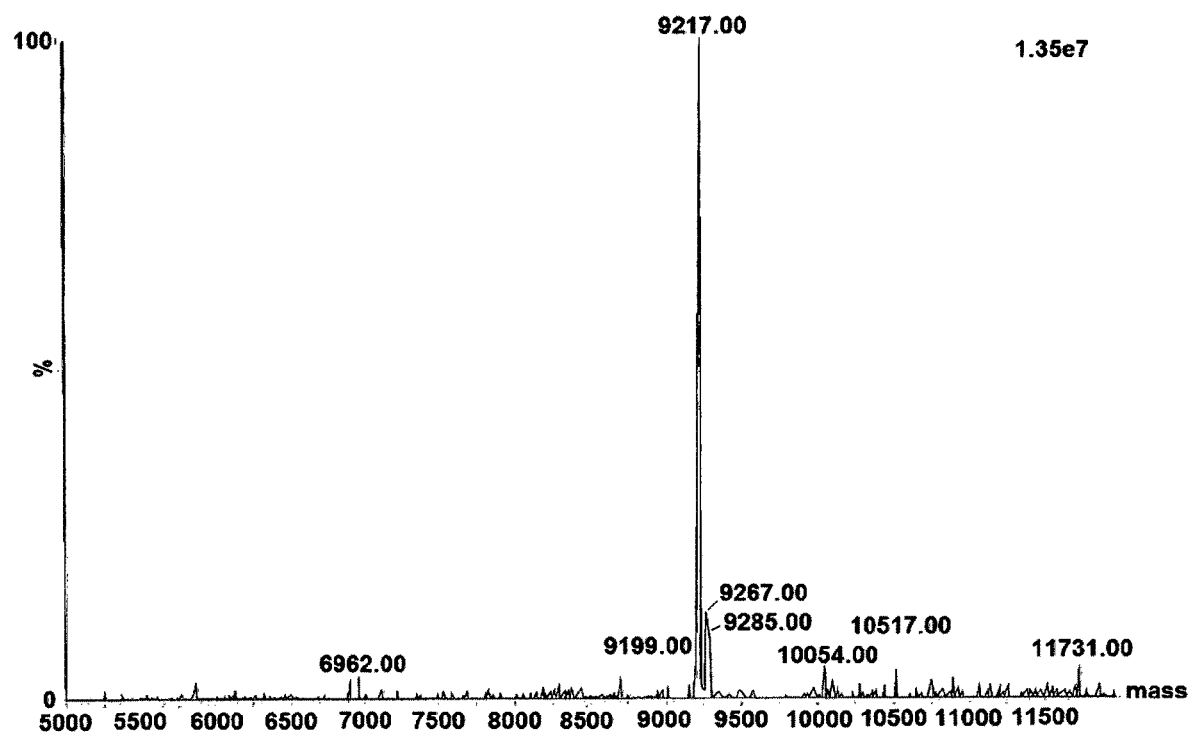
Figure 31:
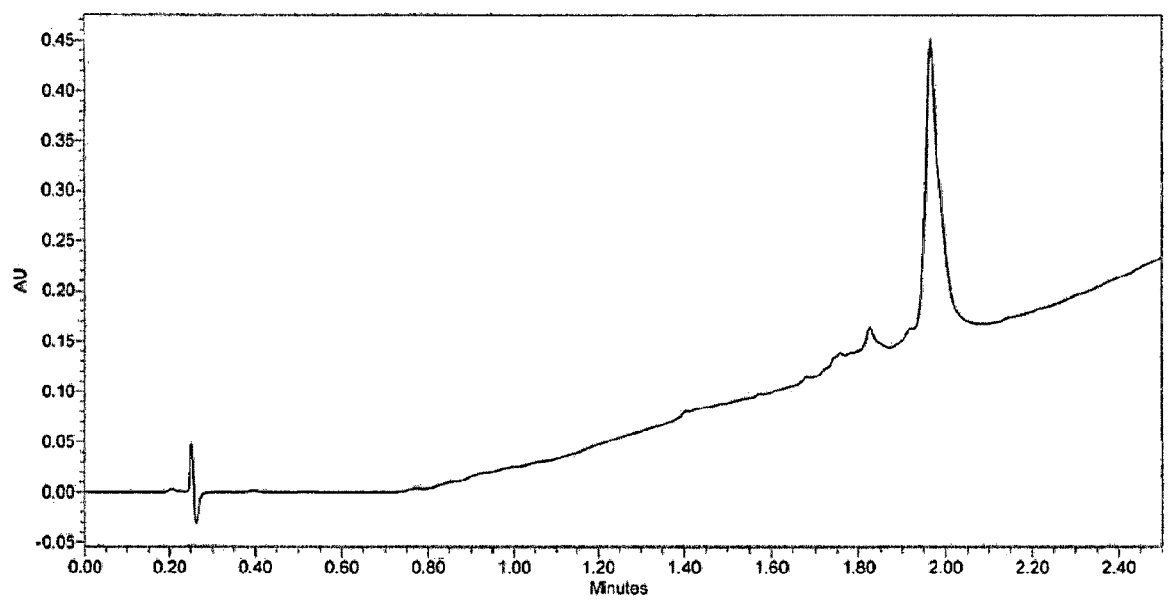
Figure 32:
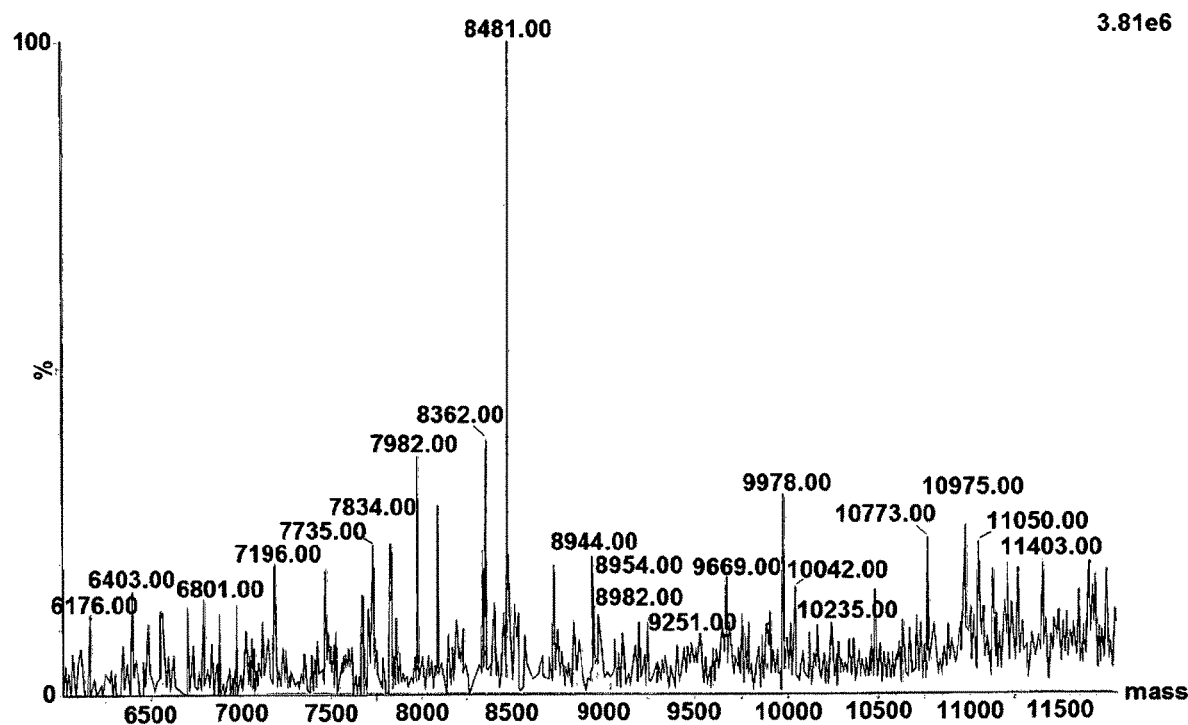
Figure 33:
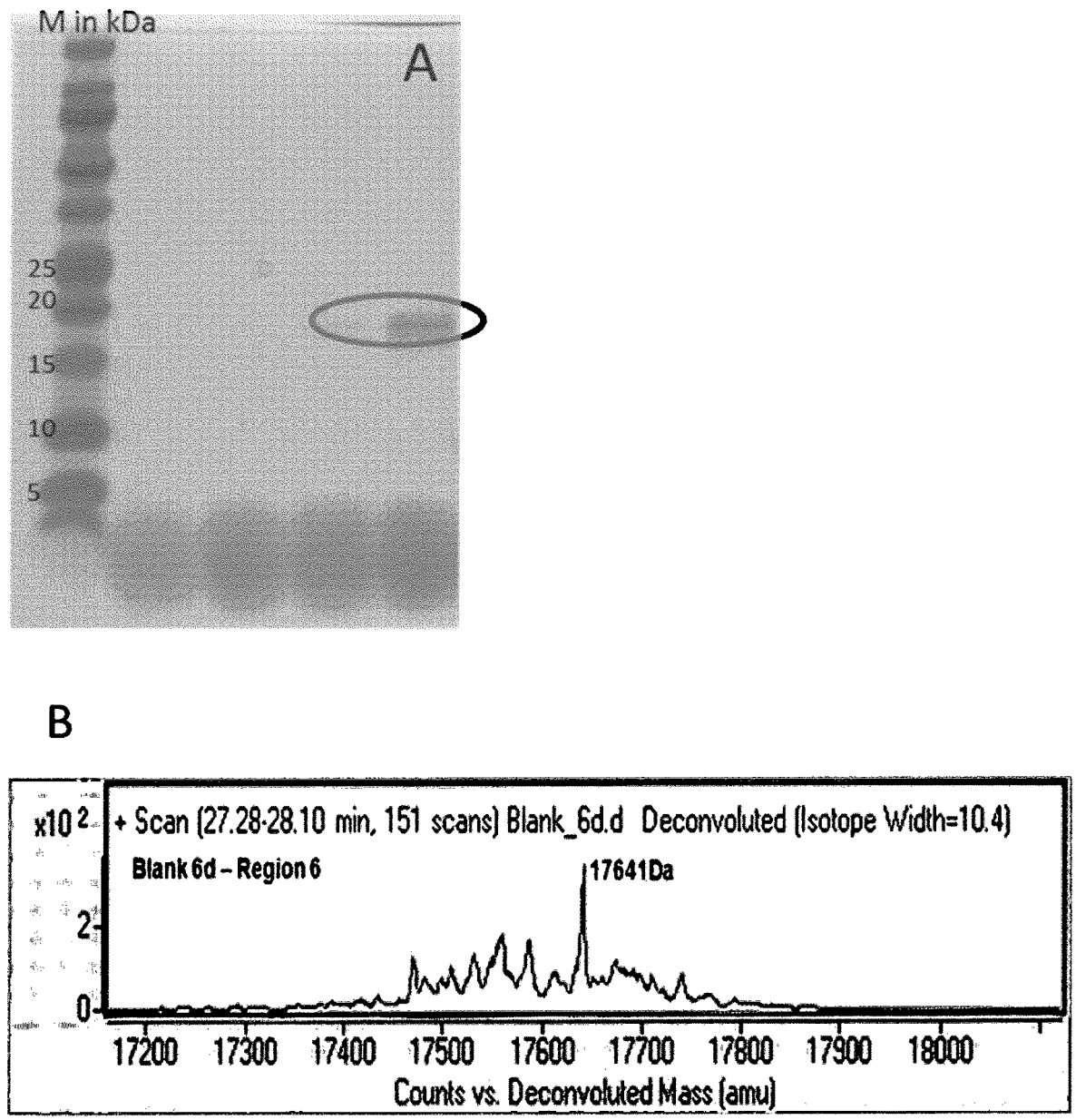

FIG. 11 A-B shows analytics of synthetic all-L-polymerase dpo4 variant A155C by SDS-PAGE (A) and LC-ESI mass spectometry (B);

FIG. 12 A shows gel electrophoresis of D-DNA PCR activity assays of L-polymerase dpo4 variants A155C, V203C, C31S and A155C/V203C;

FIG. 12 B shows gel electrophoresis of D-DNA PCR activity assays of recombinant and synthetic L-polymerase dpo4;

FIG. 12 C shows gel electrophoresis of D-DNA PCR activity assays of L-polymerase dpo4 variants A71C/A155C/V203C, S86C/A155C/V203C and C31S/S86C/A155C/V203C;

FIG. 12 D shows gel electrophoresis of D-DNA PCR activity assays of L-polymerase dpo4 variants M76G/A155C/V203C and M76A/A155C/V203C;

FIG. 12 E shows gel electrophoresis of D-DNA PCR activity assays of L-polymerase dpo4 variants I67C/A155C/V203C, S86G/A155C/V203C and S96C/A155C/V203C;

FIG. 12 F shows gel electrophoresis of D-DNA PCR activity assays of L-polymerase dpo4 C-terminus truncation forms Δ3, Δ6, Δ9, Δ12 and Δ15;

FIG. 13 shows analytics of synthesized D-polypeptide product H-RTFPHGISKETAYSESVKLLQKI-LEEDERKIRRIGVRFSKFIEAIGL DKFFDT-NH2 (SEQ ID NO: 81) (1) by mass spectrometry;

FIG. 14 shows analytics of synthesized D-polypeptide product Boc-VDTLSIEFDKLKGMIGEAKAKYLIS-LARDEYNEPIRTRVRKSIGRI VTMKRNSRNLEE-IKPYLFRAIEESYYKLDKRIPKAIHVVAVTEDL DIVSRG-OH (2) (SEQ ID NO: 82) by mass spectrometry;

FIG. 15 shows analytics of fragment condensation D-polypeptide product H-VDTLSIEFDKLKGMIGEAKA-KYLISLARDEYNEPIRTRVRKSIG RIVTMKRNSRN-LEEIKPYLFRAIEESYYKLDKRIPKAIHVVAVTE DLDIVSRGRTFPHGISKETAYSESVKLLQKI-LEEDERKIRRIGVRFS KFIEAIGLDKFFDT-NH$_2$ (3) (SEQ ID NO: 83) by mass spectrometry;

FIG. 16 A-B shows analytics of synthesized D-polypeptide product Z-CDMAKPNGIKVIDDEEVKRLIRE-LDIADVPGIGNITAEKLKKLG INKL-benzyl-thioester (4) (SEQ ID NO: 84) by RP-HPLC (A) and mass spectrometry (B);

FIG. 17 A-B shows analytics of synthesized D-polypeptide product H-RKEVYQQVSSRIMNLLREYSEKIE-IASIDEAYLDISDKVRDYREA YNL-GLEIKNKILEKEKITVTVGISKNKVFAKIA-SMe (7) (SEQ ID NO: 85) by UPLC (A) and mass spectrometry (B);

FIG. 18 A-B shows analytics of synthesized D-polypeptide product Ac-MIVLFVDFDYFYAQVEEVLNPSLKGKPVVVCVFS-GRFEDSGAV ATANYEARKFGVKAGIPIVEAKKILP-NAVYLPM-OGp (6) (SEQ ID NO: 86) by UPLC (A) and mass spectrometry (B);

FIG. 19 A-B shows analytics of clostripain mediated D-polypeptide ligation product Ac-MIVLFVDFDYFYAQVEEVLNPSLKGKPVVVCVFS-GRFEDSG AVATANYEARKFGVKAGIPIVEAKKILP-NAVYLPMRKEVYQQV SSRIMNLLREYSEKIEIASIDE-AYLDISDKVRDYREAYNLGLEIKN KILEKEKITVTVGISKNKVFAKIA-SMe (8) (SEQ ID NO: 88) by SDS-PAGE (A) and ESI mass spectrometry (B);

FIG. 20 A-B shows analytics of native chemical ligation product of all-L-polymerase dpo4 fragment 155-352 (V203C) by SDS-PAGE (A) and LC-ESI mass spectometry (B);

FIG. 21 shows analytics of synthesized D-polypeptide product H-CVYLPMRKEVYQQVSSRIMNLLREYSEK-IEIASIDEAYLDISDKV RDYREAYNL-GLEIKNKILEKEKITVTVGISKNKVFAKIA-SBzl (9) (SEQ ID NO: 344) by UPLC;

FIG. 22 shows analytics of synthesized D-polypeptide product H-CVYLPMRKEVYQQVSSRIMNLLREYSEK-IEIASIDEAYLDISDKV RDYREAYNL-GLEIKNKILEKEKITVTVGISKNKVFAKIA-SBzl (9) (SEQ ID NO: 344) by mass spectrometry;

FIG. 23 shows analytics of synthesized D-polypeptide product Ac-MIVLFVDFDYFYAQVEEVLNPSLKGKPVVVCVFS-GRFEDSGAV ATANYEARKFGVKAGIPIVEAKKILPN-SBzl (11) (SEQ ID NO: 345) by UPLC;

FIG. 24 shows analytics of synthesized D-polypeptide product Ac-MIVLFVDFDYFYAQVEEVLNPSLKGKPVVVCVFS-GRFEDSGAV ATANYEARKFGVKAGIPIVEAKKILPN-SBzl (11) (SEQ ID NO: 345) by mass spectrometry;

FIG. 25 A-B shows analytics of synthesized D-polypeptide product Z-CDMAKPNGIKVIDDEEVKRLIRE-LDIADVPGIGNITAEKLKKLGIN KL-benzyl-thioester (7) (SEQ ID NO: 84) by UPLC (A) and ESI-LC-MS (B);

FIG. 26 A-B shows analytics of all-D-peptide native chemical ligation product H-CDMAKPNGIKVIDDEEVI-CRLIRELDIADVPGIGNITAEKLKKLGIN KLCDTL-SIEFDKLKGMIGEAKAKYLISLARDEYNEPIR-TRVRKSIG RIVTMKRNSRNLEEIKPYLFRAIEE-SYYKLDKRIPKAIHVVAVTE DLDIVSRGRTFPHGIS-KETAYSESVKLLQKILEEDERKIRRIG VRFSK-FIEAIGLDKFFDT-NH2 (8) (SEQ ID NO: 375) by SDS-PAGE (A) and ESI-LC-MS (B);

FIG. 27 A-B shows analytics of all-D-peptide native chemical ligation product Ac-MIVLFVDFDYFYAQVEEVLNPSLKGKPVVVCVFS-GRFEDSGAV ATANYEARKFGVKAGIPIVEAKKIL-PNCVYLPMRKEVYQQVSSR IMNLLREYSEKIE-IASIDEAYLDISDKVRDYREAYNLGLEIKNKIL EKEKITVTVGISKNKVFAKIA-SBzl (11) (SEQ ID NO: 346) by SDS-PAGE (A) and ESI-LC-MS (B);

FIG. 28 A-C shows analytics of all-D-polymerase Dpo4 variant A71C/A155C/V203C native chemical ligation product by SDS-PAGE (A and B) and ESI-LC-MS (C);

FIG. 29 shows analytics of synthesized D-polypeptide product H-RKEVYQQVSSRIMNLLREYSEKIEIASIDE-AYLDISDKVRDYREA YNLGLEIKNKILEKEKITVTV-GISKNKVFAKIA-SBzl (9) (SEQ ID NO: 348) by UPLC;

FIG. 30 shows analytics of synthesized D-polypeptide product H-RKEVYQQVSSRIMNLLREYSEKIEIASIDE-AYLDISDKVRDYREA YNLGLEIKNKILEKEKITVTV-GISKNKVFAKIA-SBzl (9) (SEQ ID NO: 348) by mass spectrometry;

FIG. 31 shows analytics of synthesized D-polypeptide product Ac-MIVLFVDFDY FYAQVEEVLNP SLKGKPVVV CVFSGRFEDS GAVATANYEA RKFGVKAGIP IVEAKKILPN AVYLPG-OGp (10) (SEQ ID NO: 347) by UPLC;

FIG. 32 shows analytics of synthesized D-polypeptide product Ac-MIVLFVDFDY FYAQVEEVLNP SLKGKPVVV CVFSGRFEDS GAVATANYEA RKFGVKAGIP IVEAKKILPN AVYLPG-OGp (10) (SEQ ID NO: 347) by mass spectrometry;

FIG. 33 A-B shows analytics of protease catalyzed all-D ligation product Ac-MIVLFVDFDYFYAQVEEVLNPSLKGKPVVVCVFS-GRFEDSGAV ATANYEARKFGVKAGIPIVEAKKILP-NAVYLPGRKEVYQQVSSRI MNLLREYSEKIEIASIDE-AYLDISDKVRDYREAYNLGLEIKNKILE KEKITVTVGISKNKVFAKIA-SBzl (11) (SEQ ID NO: 349) by SDS-PAGE (a) and ESI-LC-MS (B);

FIG. 34 shows analytics of synthesized crude all-D peptide H-KAIHVVAVT EDLDIVSRGR TFPHGISKET AYSESVKLLQ KILEEDERKI RRIGVRFSKF IEAIGLDKFF DT-NH$_2$ (1) (SEQ ID NO: 350) UPLC profile (a) and mass spectrum (b);

FIG. 35 shows analytics of synthesized crude all-D peptide H-CDTLSIEF DKLKGMIGEA KAKYLISLAR DEYNEPIRTR VRKSIGRIVT MKRNSRNLEE IKPYL-FRAIE ESYYKLDKRI P-OH (3) (SEQ ID NO: 351) UPLC profile (a) and mass spectrum (b);

FIG. 36 shows analytics of H-CDTLSIEF DKLKGMI-GEA KAKYLISLAR DEYNEPIRTR VRKSIGRIVT MKRNSRNLEE IKPYLFRAIE ESYYKLDKRI PKAIHVVAVT EDLDIVSRGR TFPHGISKET AYSESVKLLQ KILEEDERKI RRIGVRFSKF IEAIGLDKFF DT-NH$_2$ (5) (SEQ ID NO: 369) synthesized by fragment condensation UPLC profile (a) and mass spectrum (b);

FIG. 37 shows analytics of synthesized and purified all-D peptide H-CVYLPMRKEV YQQVSSRIMN LLREY-SEKIE IASIDEAYLD ISDKVRDYRE AYNLGLEIKN KILEKEKITV TVGISKNKVF AKIA-NHNH$_2$ (9) (SEQ ID NO: 352) UPLC profile (a) and mass spectrum (b).

EXAMPLES

Abbreviation as used in the examples.
ACN acetonitrile (Sigma-Aldrich Chemie GmbH, Schnelldorf, Deutschland)
DCM dichloromethane (Sigma-Aldrich Chemie GmbH, Schnelldorf, Deutschland)
DIPEA N,N-diisipropylamine (Sigma-Aldrich Chemie GmbH, Schnelldorf, Deutschland)
EDT (Sigma-Aldrich Chemie GmbH, Schnelldorf, Deutschland)
Fmoc 9-Fluorenyl-methoxycarbonyl-
HATU (2-(7-Aza-1H-benzotriazole-1-yl)-1,1,3,3-tetramethyluronium hexafluorophosphate) (CreoSalus, Louisville Ky., USA)
HFIP 1,1,1,3,3,3-hexafluorophosphate(Sigma-Aldrich Chemie GmbH, Schnelldorf, Deutschland)
HPLC High-performance liquid chromatography (sometimes referred to as high-pressure liquid chromatography)
MeIm methyl imidazole (Sigma-Aldrich Chemie GmbH, Schnelldorf, Deutschland)
MeOH methanol (Sigma-Aldrich Chemie GmbH, Schnelldorf, Deutschland)
MSNT 1-(Mesitylene-2-sulfonyl)-3-nitro-1,2,4-triazole (Merck KGaA, Darmstadt, Germany)
NMP N-methyl-pyrrolidone (Iris Biotech GmbH, Marktredwitz, Deutschland)

PyBOP (Benzotriazol-1-yloxy)tripyrrolidinophosphoniumhexafluorophosphat (MERCK KGAA, DARMSTADT, GERMANY)
SDS Sodium dodecyl sulfate (Sigma-Aldrich Chemie GmbH, Schnelldorf, Deutschland)
TBTU O-(Benzotriazol-1-yl)-N,N,N',N'-tetramethyluroniumtetrafluoroborat (Merck KGaA, Darmstadt, Germany)
tBu (tert.-Butyl-)
TFA trifluoroacetic acid (Sigma-Aldrich Chemie GmbH, Schnelldorf, Deutschland)
TFE 1,1,1-trifluoroethanol(Sigma-Aldrich Chemie GmbH, Schnelldorf, Deutschland)
THF (Sigma-Aldrich Chemie GmbH, Schnelldorf, Deutschland)
TIS (Sigma-Aldrich Chemie GmbH, Schnelldorf, Deutschland)
TLC Thin layer chromatography
Tris Tris(hydroxymethyl)aminomethane (Sigma-Aldrich Chemie GmbH, Schnelldorf, Deutschland)
UPLC Ultra-performance liquid chromatography Example 1—Recombinant Expression and Purification of Wild-Type and Variants of Polymerase X Polymerase X from African swine fever virus (abbr. ASFV) was described and characterized by Oliveros et al in 1997. The wild-type gene of the polymerase X has an open reading frame (abbr. ORF) of only 525 base pairs including start codon and stop codon (Oliveros et al, 1997). The encoded protein has a length of only 174 amino acids. This example describes how polymerase X as well as variants thereof have been expressed in *E. coli* and been purified using a His$_6$-Tag.

1.1 Expression Constructs

Since the codon usage of ASFV differs from *E. coli*, an *E. coli*-codon-optimized synthetic gene for polymerase X was purchased from GeneArt AG (Regensburg, Germany). The synthetic gene sequence was provided in pCR4-Blunt-TOPO vector (originator company: Invitrogen, Karlsruhe, Germany). The codon-optimized open reading frame including start codon and two stop codons had the following sequence:

```
                                          (SEQ ID NO: 26)
ATGCTGACCCTGATTCAGGGCAAAAAAATCGTGAACCATCTGCGTAGCCG

TCTGGCCTTTGAATATAACGGCCAGCTGATTAAAATTCTGAGCAAAAACA

TTGTGGCGGTGGGCAGCCTGCGTCGTGAAGAAAAAATGCTGAACGATGTG

GATCTGCTGATTATTGTGCCGGAAAAAAAACTGCTGAAACATGTGCTGCC

GAACATTCGTATTAAAGGCCTGAGCTTTAGCGTGAAAGTGTGCGGCGAAC

GTAAATGCGTGCTGTTTATCGAATGGGAAAAAAAAACCTACCAGCTGGAC

CTGTTTACCGCGCTGGCCGAAGAAAAACCGTATGCGATCTTTCATTTTAC

CGGTCCGGTGAGCTATCTGATTCGTATTCGTGCGGCGCTGAAAAAAAAAA

ACTACAAACTGAACCAGTATGGCCTGTTTAAAAACCAGACCCTGGTGCCG

CTGAAAATTACCACCGAAAAAGAACTGATTAAAGAACTGGGCTTTACCTA

TCGCATTCCGAAAAAACGCCTGTAATAA.
```

In order to obtain an expression construct for polymerase X, also referred to as all-L polymerase X, the gene of the polymerase X was cut out from pCR4-Blunt-TOPO with BamHI and PstI and subcloned in pRSET-A vector (Invitrogen, Karlsruhe, Germany). Subcloning added a His$_6$-Tag to the N-terminus, and brought the gene under control of the T7 promoter. The construct was named pMJ14 and was used for expression of all-L polymerase X in *E. coli*. The protein polymerase X expressed from pMJ14 had the following sequence of 210 amino acids:

```
                                          (SEQ ID NO: 27)
MRGSHHHHHHGMASMTGGQQMGRDLYDDDDKDRWGSMLTLIQGKKIVNHL

RSRLAFEYNGQLIKILSKNIVAVGSLRREEKMLNDVDLLIIVPEKKLLKH

VLPNIRIKGLSFSVKVCGERKCVLFIEWEKKTYQLDLFTALAEEKPYAIF

HFTGPVSYLIRIRAALKKKNYKLNQYGLFKNQTLVPLKITTEKELIKELG

FTYRIPKKRL.
```

The initial 36 amino acids represented the His$_6$-Tag including a few spacer amino acids and some other sequence tags (T7 Gene 10 leader, Anti-Express Epitope). The final 174 amino acid part was identical to the polymerase X protein sequence as found in ASFV.

Expression constructs for variants of all-L polymerase X were made using the commercially available QuikChange kit (Stratagene GmbH, Waldbronn, Germany) according to manufacturer's protocol. Plasmid pMJ14 served as template. Oligonucleotides needed for QuikChange were either synthesized at the NOXXON facility (QC10_up, QC10_low) or purchased from Purimex (Grebenstein, Germany) (QC26_up, QC26_low, QC27_up, QC27_low, QC31_up, QC31_low). The following variant expression constructs were made and used for expression of the variants of the all-L polymerase in *E. coli*:

| variant | expression construct | oligonucleotides used for QuikChange mutagenesis procedure | |
|---|---|---|---|
| I124G | pMJ130 | QC10_up | |
| | | (5'-TCCGGTGAGCTATCTGGGTCGTATTCGTGCGGCG-3') | (SEQ ID NO: 28) |
| | | QC10_low | |
| | | (5'-CGCCGCACGAATACGACCCAGATAGCTCACCGGA-3') | (SEQ ID NO: 29) |
| V80G | pMJ356 | QC26_up | |
| | | (5'-TGAGCTTTAGCGTGAAAGGGTGCGGCGAACG-3') | (SEQ ID NO: 30) |
| | | QC26_low | |
| | | (5'-CGTTCGCCGCACCCTTTCACGCTAAAGCTCA-3') | (SEQ ID NO: 31) |

-continued

| variant | expression construct | oligonucleotides used for QuikChange mutagenesis procedure |
|---------|---------------------|------------------------------------------------------------|
| V80A | pMJ357 | QC27_up<br>(5'-TGAGCTTTAGCGTGAAAGCGTGCGGCGAACG-3') (SEQ ID NO: 32)<br>QC27_low<br>(5'-CGTTCGCCGCACGCTTTCACGCTAAAGCTCA-3') (SEQ ID NO: 33) |
| C86S | pMJ412 | QC31_up<br>(5'-TGAAAGTGTGCGGCGAACGTAAAAGCGTGCTGTTTA-3') (SEQ ID NO: 34)<br>QC31_low<br>(5'-TAAACAGCACGCTTTTACGTTCGCCGCACACTTTCA-3') (SEQ ID NO: 35) |

1.2 Protein Expression in E. coli

All-L-polymerase X was expressed in E. coli using expression construct pMJ14. Variants of the all-L-polymerase X were expressed from pMJ130, pMJ356, pMJ357 or pMJ412. For expression, the appropriate expression construct was transformed in competent E. coli strain 'BL-21 (DE3) pLysS' (Novagen/VWR, Dresden, Germany) and maintained with the antibiotic Ampicillin. The culture was grown at 37° C. in 2YT medium until the optical density at 600 nm reached approx. 0.6. Then protein expression was induced by adding Isopropyl beta-D-1-thiogalactopyranoside (abbr. IPTG) to a final concentration of 0.4 mM. Expression was performed for 4 hours at 30° C. Cells were harvested by centrifugation and either stored at −80° C. or immediately processed.

1.3 Protein Purification

Fresh or frozen E. coli cells were resuspended on ice in 'lyse and bind buffer' (50 mM Na-Phosphate, pH 7.5, 500 mM NaCl, 40 mM Imidazole) and lysed using a 'French Press' (G. Heinemann, Schwäbisch Gmünd, Germany) cell disrupter. Purification was done at 4° C. using 'Ni-NTA Superflow' material (Qiagen, Hilden, Germany). Step elution was done with elution buffer (50 mM Na-Phosphate, pH 7.5, 500 mM NaCl, 200 mM Imidazole). Fractions were analyzed using SDS-PAGE (Invitrogen, Karlsruhe, Germany), pooled and, if required, further purified with anion-ion-exchange chromatography on an 'ÄKTA purifier' system using 'Q Sepharose fast flow' material (GE healthcare, Freiburg, Germany). Protein identity was confirmed by MALDI mass spectometry and correct fractions were pooled, concentrated and re-buffered. Purified protein was stored at −20° C. in a buffer consisting of 25 mM Na-Phosphate, pH 7.5, 250 mM NaCl, 50% glycerol. Protein concentrations were estimated by BCA-protein assay (Pierce/Perbio Science, Bonn, Germany) using a bovine serum albumin (abbr. BSA) standard.

Example 2—Activity Confirmation of Polymerase X and Variants of Polymerase X

The activity assays for the all-L-polymerase X and variants of all-L-polymerase X (see Example 1) were done with different types of substrate complexes formed by oligonucleotides, wherein the substrates and oligonucleotides consists of D-DNA-nucleotides.

2.1 Activity Assays on Substrates with 1-Nucleotide Gap

List of oligonucleotides for the 1-gap substrates:

| Name | Length, nt | Sequence (5'→3') |
|------|------------|------------------|
| SP-1 | 15 | GATCACAGTGAGTAC (SEQ ID NO: 36) |
| D(g1)P | 17 | Phosphate-GTAAAACGACGGCCAGT (SEQ ID NO: 37) |
| MJ_1_140_DD | 33 | ACTGGCCGTCGTTTTACAGTACTCACTGTGATC (SEQ ID NO: 38) |
| MJ_1_141_DD | 33 | ACTGGCCGTCGTTTTACCGTACTCACTGTGATC (SEQ ID NO: 39) |
| MJ_1_142_DD | 33 | ACTGGCCGTCGTTTTACGGTACTCACTGTGATC (SEQ ID NO: 40) |
| SP1c + 18(g1) | 33 | ACTGGCCGTCGTTTTACTGTACTCACTGTGATC (SEQ ID NO: 41) |

Substrate complexes were made by annealing a template strand of a DNA oligonucleotide consisting of 33 nucleotides (also referred to as lower strand) with two different DNA oligonucleotides consisting of 15 and 17 nucleotides, respectively, which hybridized to the template strand at its 5'-end and 3'end, respectively, resulting in a gap of one nucleotide in the upper strand. The complexes contained either A, C, G or T at the template position within the gap. Before annealing, oligonucleotide SP-1 consisting of 15 nucleotides was radioactively labeled at its 5'-end with $^{32}$P by a standard kinase reaction employing Gamma-$^{32}$P-Adenosine-Triphosphate (ATP) and T4 polynucleotide kinase. Annealing was done in 10 mM Tris-HCl, 5 mM MgCl$_2$, pH 8.0 by heating 10 mM at 65° C. and slowly cooling down. Unincorporated gamma-$^{32}$P-ATP was removed by purification over NAP-columns (GE healthcare).

In the activity assay, all-L-polymerase X and the variants thereof were combined with D-configurated 1-gap substrate complexes (see FIG. 1A). As a negative control, each substrate was also incubated without all-L-polymerase X and variants thereof and D-desoxy-nucleotide-triphosphates (dNTP's). Depending on the template base within the 1-gap complex only the corresponding D-dNTP was added during the assay. A typical 6 µl assay contained 50 nM substrate complex, 1.7 ng/µl L-all-L-polymerase X or variants thereof, 8 µM of one D-dNTP and buffer (50 mM Tris-HCl, 10 mM MgCl$_2$, 4% glycerol, 0.1 mg/ml bovine serum albumin (BSA), pH 7.5). D-dNTP's were purchased from Rovalab (Teltow, Germany). The incubation time was 30 minutes at 37° C. The whole assay volume was mixed with sample buffer/dye, loaded on a denaturing sequencing gel a separated for 4 hours. The gel was exposed to Kodak K screen overnight at −80° C. and read out using BioRad Fx phosphoimager system.

All-L-polymerase X and the variants I124G, V80A and V80G were active under these conditions and filled the 1 nucleotide gap between the two upper strand DNA oligonucleotides.

2.2 Activity Assay on a Substrate with 6-Nucleotide Gap

List of oligonucleotides for the 6-gap substrate:

| Name | Length, nt | Sequence (5'→3') |
|---|---|---|
| SP-1 | 15 | GATCACAGTGAGTAC (SEQ ID NO: 36) |
| D(g6)P | 12 | Phosphate-ACGACGGCCAGT (SEQ ID NO: 42) |
| SP1c + 18 (g6) | 33 | ACTGGCCGTCGTTCTATTGTACTCACTGTGATC (SEQ ID NO: 14) |

Substrate complexes were made by annealing a template strand of a DNA oligonucleotide consisting of 33 nucleotides (referred to as lower strand) with two different DNA oligonucleotides consisting of 15 and 12 nucleotides, respectively, which hybridized to the template strand at its 5'-end and 3'end, respectively, resulting in a gap of six nucleotides in the upper strand. Before annealing, oligonucleotide SP-1 consisting of 15 nucleotides was radioactively labeled at its 5'-end with $^{32}$P by a standard kinase reaction employing Gamma-$^{32}$P-Adenosine-Triphosphate (ATP) and T4 polynucleotide kinase. Annealing was done in 10 mM Tris-HCl, 5 mM MgCl$_2$, pH 8.0 by heating 10 min at 65° C. and slowly cooling down. Unincorporated gamma-$^{32}$P-ATP was removed by purification over NAP-columns (GE healthcare, Freiburg, Germany).

In the activity assay, all-L-polymerase X and variants thereof were combined with D-configurated 6-gap substrate complex (FIG. 1B). As a negative control, the substrate was also incubated without all-L-polymerase X or variants thereof and desoxy-nucleotide-triphosphates (D-dNTP's). A typical 6 μl assay contained 50 nM substrate complex, up to 1.3 ng/μl all-L-polymerase X or variants thereof, 8 μM each of the D-dNTP's and buffer (50 mM Tris-HCl, 10 mM MgCl2, 4% glycerol, 0.1 mg/ml bovine serum albumin (BSA), pH 7.5). D-dNTP's were purchased from Rovalab (Teltow, Germany). A typical incubation time was 30 minutes at 37° C. The whole assay volume was mixed with sample buffer/dye, loaded on a denaturing sequencing gel a separated for 4 hours. The gel was exposed to Kodak K screen overnight at −80° C. and read out using BioRad Fx phosphoimager system.

All-L-polymerase X and the variants (except C86S) were active under these conditions and filled the 6 nucleotide gap between the two upper strand DNA oligonucleotides.

Example 3—Synthesis of a Variant of Polymerase Pol X Consisting of D-Amino Acids Within the example the synthesis of the all-D polymerase X variant V80A is described. The amino acid sequence of the all-D polymerase X variant V80A is Ac-MLTLIQGK-KIVNHLRSRLAFEYNGQLIKILSKNIVAVGSLR-REEKMLNDVDLLIIVPEK KLLKHVLPNIRIKGLSFSVKACGERKCVLFIEWEKKT YQLDLFTALAEEKPYAIFHFTG PVSYLIRIRAALKK-KNYKLNQYGLFKNQTLVPLKITTEKELIKELGFTYR-IPKKRL-OH. (SEQ ID NO:3)

All amino acids used are protected according to the Solid-phase peptide synthesis Fmoc/tBu-strategy requirements (Eric Atherton et al., 1981). All amino acids used are D-amino acids (Bachem, Bubendorf, Switzerland).

3.1 Synthesis of HO-Gp(Boc)$_2$

The tert-butyloxycarbonyl-protected 4-guanidinophenol was synthesized in analogy to Sekizaki et al. (Sekizaki et al., 1996). According to this 40 mmol N,N'-Bis-(tert-butyloxycarbonyl)-S-methylisothiourea (Sigma-Aldrich Chemie GmbH, Schnelldorf, Deutschland) and 60 mmol 4-aminophenol (Sigma-Aldrich Chemie GmbH, Schnelldorf, Deutschland) were dissolved in 250 ml THF in a 500 ml bottom round flask. Following this the solution was argon flushed for 10 min and kept stirring for 120 hours while sealed with a CaCl$_2$ tube.

After evaporating the solvent the residue was precipitated with ice cold methanol. The precipitate was dried under vacuum over P$_4$O$_{10}$. Finally the product was purified using flash chromatography with DCM. Product containing fractions were combined and the solvent was evaporated under reduced pressure. TLC, reversed phase HPLC, mass spectrometry and NMR were used for analytics. The experimentally determined mass corresponds to the calculated mass of 351 Da.

3.2 Synthesis of H-D-Leu-OGp(Boc)$_2$ 1 mmol Z-D-Leu-OH (Bachem, Bubendorf, Switzerland), 0.9 eq. TBTU and 0.9 eq. HO-Gp(Boc)$_2$ were dissolved in 10 ml DMF. After addition of 2 eq. DIPEA the solution was stirred for 2 hours. After evaporating the solvent the raw product was purified with flash chromatography using DCM. Pure fractions of Z-D-Leu-OGp(Boc)$_2$ were combined and the solvent was evaporated.

Z-D-Leu-OGp(Boc)$_2$ was dissolved in 10 ml MeOH and flushed with argon. Hydrolytic cleavage of the N-terminal Z-group was achieved by the addition of Pd/C catalyst and H$_2$ in 2 hours. After filtrating off H-D-Leu-OGp(Boc)$_2$ MeOH was evaporated under reduced pressure. Analytics was performed using reversed phase HPLC and mass spectrometry. The correct mass of 465 Da for the product was found and is in correspondence the calculated mass.

3.3 Synthesis of All-D-Peptide AcMLTLIQGK-KIVNHLRSRLAFEYNGQLIKILSKNIVAVGSL-OGp (1) (SEQ ID NO: 43)

0.10 mmol TentaGel-R-Trityl resin (Rapp Polymere, Tubingen, Deutschland) was loaded with Fmoc-D-Ser(tBu)-OH (Bachem, Bubendorf, Switzerland) as described by Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Ser (tBu)-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 (Applied Biosystems, Foster City, USA) with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine (Sigma-Aldrich Chemie GmbH, Schnelldorf, Deutschland) in NMP.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

0.01 mmol fully protected peptide, 4 eq. PyBOP and 5 eq. H-D-Leu-OGp(Boc)$_2$ were dissolved in 6 ml NMP. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column (Phenomenex, Aschaffenburg, Germany) using an ACN/water gradient. Fractions that contain product were combined and freeze dried.

The final product was characterised by HPLC/UPLC (FIG. 2A) and mass spectrometry (FIG. 2B). The measured mass for the product of 4654.7 Da is in correspondence to the theoretical mass of 4652.7 Da.

3.4 Synthesis of all-D-peptide H-RREEKLNDVDLLIIV-PEKKL LKHVLPNIRIKGLSFSVKA-SMe (2) (SEQ ID NO: 44)

0.10 mmol TentaGel-R—NH$_2$ resin (Rapp Polymere, Tubingen, Deutschland) was loaded with Fmoc-D-Ala-OH using 5 eq. amino acid, eq. 4.9 eq. HATU and 10 eq. DIPEA for 45 min in 6 ml NMP. Subsequently the resin was washed with THF. Conversion to Fmoc-d-Ala-Ψ[CS-NH]-R-Tenta-Gel was achieved by incubation with 4 eq. Lawesson reagent in THF at 80° C. for 2 hours. Following this the resin was washed with NMP. Subsequently the so prepared resin was used in automated peptide synthesis as described previously (see Example 1.3).

Following this the corresponding thioester was generated by incubation with methyl iodide in DMF overnight according to Sharma et al. (Sharma et al., 2011). After filtering of the resin the peptide thioester containing solvent was evaporated and the residue precipitated using ice cold diethyl ether. The cleavage of side chain protection groups was performed with 2.5% EDT, 2.5% water, 2.5% TIS in TFA for 2 hours. Following the evaporation of TFA the peptide was precipitated with ice cold diethyl ether. Reversed phase HPLC purification of the peptide thioester was performed on a C18 column (Phenomenex, Aschaffenburg, Germany) using an ACN/water gradient. Fractions that contain product were combined and freeze dried.

The final product was characterised by HPLC/UPLC (FIG. 3A) and mass spectrometry (FIG. 3B). The experimentally determined mass for the product (4683.8 Da) is in accordance with the theoretical value of 4681.7 Da 3.5 Synthesis of all-D-peptide H-CGERKCVLFIEWEKKTYQLDLFTA-LAEEKPYAIFHFTGPVSYLIRIRAALKKKNYKL NQYGLFKNQTLVPLKITTEKELIKELGFTYRIPKKRL-OH (3) (SEQ ID NO: 45)

0.10 mmol TentaGel-R-PHB resin (Rapp Polymere, Tubingen, Deutschland) was loaded with Fmoc-D-Leu-OH using 6 eq. amino acid, 6 eq. MSNT and 4.5 eq MeIm in DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 mM with 20% (v/v) piperidine in NMP. Double coupling steps were performed after 42 amino acids. Cleavage of the N-terminal Fmoc-protected peptide was achieved using 2.5% EDT, 2.5% water, 2.5% TIS in TFA for 2 hours. Following the evaporation of TFA the peptide was precipitated with ice cold diethyl ether. Reversed phase HPLC purification of the crude N-terminal protected peptide was performed on a C18 column using an ACN/water gradient. Product containing fractions were combined and freeze dried. The Fmoc-protected peptide was subsequently dissolved and stirred in 20% piperine in DMF for cleaving off the N-terminal Fmoc-group. After 20 min the solvent was evaporated and the residue precipitated using ice cold diethyl ether. Subsequently the precipitated crude peptide was purified using reversed phase HPLC with C18 column with an ACN/water gradient. Product containing fractions were combined and freeze dried.

The final product was characterised by HPLC/UPLC (FIG. 4A) and mass spectrometry (FIG. 4B). The determined mass of the product (11184.3 Da) corresponds to the theoretical mass of 11178.2 Da.

3.6 Synthesis of All-D-Peptide Ac-MLTLIQGK-KIVNHLRSRLAFEYNGQLIKILSKNIVAVGSLR-REEKMLNDVDLLIIVP EKKLLKHVLPNIRIKGLSFSVKA-SMe (4) (SEQ ID NO: 46) by Protease-Catalyzed Ligation of Peptide 1 with Peptide 2

Peptide 1 was solved 0.2 mM and peptide 2 was solved 0.6 mM in sodium-phosphate buffer (100 mM, pH 8.5, with 100 mM NaCl) containing 2% Triton X100 (Sigma Aldrich Chemie GmbH, Schnelldorf, Germany). After addition of 20 µM Clostripain (Endoprotease Arg-C, Worthington Biochemical Corporation, Lakewood, N.J., USA) the reaction mixture was shaken overnight at 37° C. The precipitated peptides were centrifuged, solved in H$_2$O/ACN/Formic Acid 60/40/0.5 and purified by reversed-phase HPLC using a RP-18-column (Phenomenex, Aschaffenburg, Germany) with a gradient of ACN in water of 30% to 60% within 30 min. Product containing fractions were combined and freeze dried.

Figure 5:
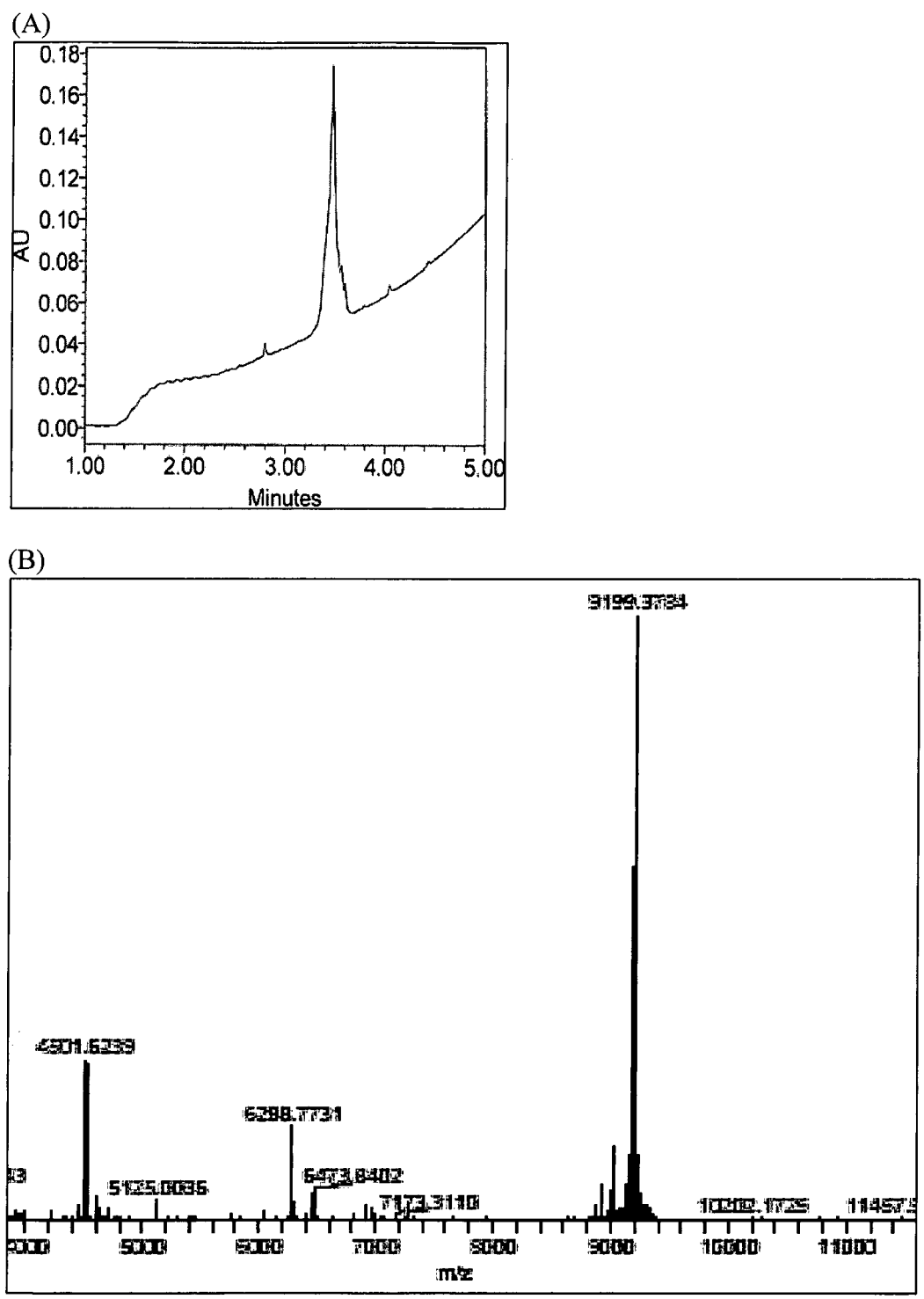

The final peptide was analyzed by reversed phase UPLC (FIG. 5A) and ESI-mass spectrometry (FIG. 5B). The theoretical molecular weight ($M_{theor}$=9199.3 Da) corresponds the observed molecular weight ($M_{obs}$=9199.4 Da).

3.7 Synthesis of All-D Polymerase X Variant V80A by Native Chemical Ligation of Peptide 4 with Peptide 3

Both peptides 3 and 4 were solved 0.2 M in TRIS-buffer (pH 8.6) containing 6 M GuanidinHCl (Sigma Aldrich Chemie GmbH, Schnelldorf, Germany), 200 mM mercaptophenyl-acetic acid (Sigma Aldrich Chemie GmbH, Schnelldorf, Germany) and 5 mm Tris(2-carboxyethyl)phosphine hydrochloride (Sigma Aldrich Chemie GmbH, Schnelldorf, Germany). The reaction mixture was shaking 72 h by room temperature. Afterwards the mixture was purified by reversed phase HPLC using a RP-8-column (Phenomenex, Aschaffenburg, Germany) with a gradient of ACN in water of 30% to 60% within 30 min. Fractions which contained the ligation product were pooled and dried. The dry powder was solved in water and purified by size exclusion chromatography using a SEC3000-column (Phenomenex, Aschaffenburg, Germany) with sodium-buffer phosphate (Sigma Aldrich Chemie GmbH, Schnelldorf, Germany) (50 mM, pH 6.8, 0.5% SDS) as eluent. Product containing fractions were combined and freeze dried.

The final product was analyzed by SDS-PAGE (FIG. 6A) and ESI-mass spectrometry (FIG. 6B). A clear band was found in lane 7 between 14.4 kDa and 21.5 kDa indicating the pure full length polymerase. The theoretical molecular weight ($M_{theor}$=20342 Da) corresponds the observed molecular weight ($M_{obs}$=20361 Da) as shown by ESI-MS.

Example 4—Activity Confirmation of Synthetic Polymerase X Variant Consisting of D-Amino Acids The dry all-D polymerase X variant V80A according to example 3 was dissolved in 6 M guanidinium hydrochloride and refolded at 4° C. by step-wise dialysis in commercially available dialysis devices (Pierce/PerBio, Bonn, Germany) with 3,500 molecular weight cut-off. Final buffer was 50 mM sodium phosphate, 500 mM sodium chloride, pH 7.5. Protein concentration was estimated by sodium dodecyl sulphate (SDS) polyacrylamide gel electrophoresis (PAGE) on pre-cast gels (Invitrogen, Karlsruhe, Germany) using a standard series of known protein concentrations followed by SYPRO-RED staining (Invitrogen, Karlsruhe, Germany) and densiometric band analysis on a BioRad Fx scanner instrument.

The activity assay for the all-D polymerase X variant V80A was done with two different substrate types:

4.1 Activity Assays on Substrates with 1-Nucleotide Gap

Substrates were made by annealing a 33-mer lower strand DNA oligonucleotide with two 17-mer upper strand DNA oligonucleotides resulting in a gap of 1 nucleotide in the upper strand. Oligonucleotides were synthesized in L-configuration. Before annealing, 17-mer upper strand oligonucleotide MJ_1_58_MD was radioactively labeled at its 5'-end with $^{32}$P by a standard kinase reaction employing Gamma-$^{32}$P-Adenosine-Triphosphate (Gamma-$^{32}$P-ATP) and T4 polynucleotide kinase. To facilitate the kinase reaction of the L-oligonucleotide MJ_1_58_MD, two D-configurated guanosine bases were added at the 5' end during oligonucleotide synthesis. Annealing was done in 10 mM Tris-HCl, 5 mM MgCl$_2$, pH 8.0 by heating 10 min at 65° C. and slowly cooling down. Unincorporated gamma-32P-ATP was removed by purification over NAP-columns (GE healthcare, Freiburg, Germany). The complexes contained either A, C, G or T at the template position within the gap. For the setup of the substrate complexes see FIG. 7.

In the activity assay, synthetic all-D polymerase X variant V80A was combined with L-configurated 1-gap substrate complexes. As a negative control, each substrate was also incubated without all-D polymerase X variant V80A and L-desoxy-nucleotide-triphosphates (dNTP's). Depending on the template base within the 1-gap complex only the corresponding L-dNTP was added during the assay. A typical 6 µl assay contained 50 nM substrate complex, 1.7 ng/µl all-D polymerase X variant V80A, 8 µM of one L-dNTP and buffer (50 mM Tris-HCl, 10 mM MgCl$_2$, 4% glycerol, 0.1 mg/ml bovine serum albumin (BSA), pH 7.5). L-dNTP's were purchased as custom synthesis from Rasayan, Inc. (Encinitas, Calif., USA). The incubation time was 30 minutes at 37° C. The whole assay volume was mixed with sample buffer/dye, loaded on a denaturing sequencing gel separated for 4 hours. The gel was exposed to Kodak K screen overnight at −80° C. and read out using BioRad Fx phosphoimager system.

Figure 8:
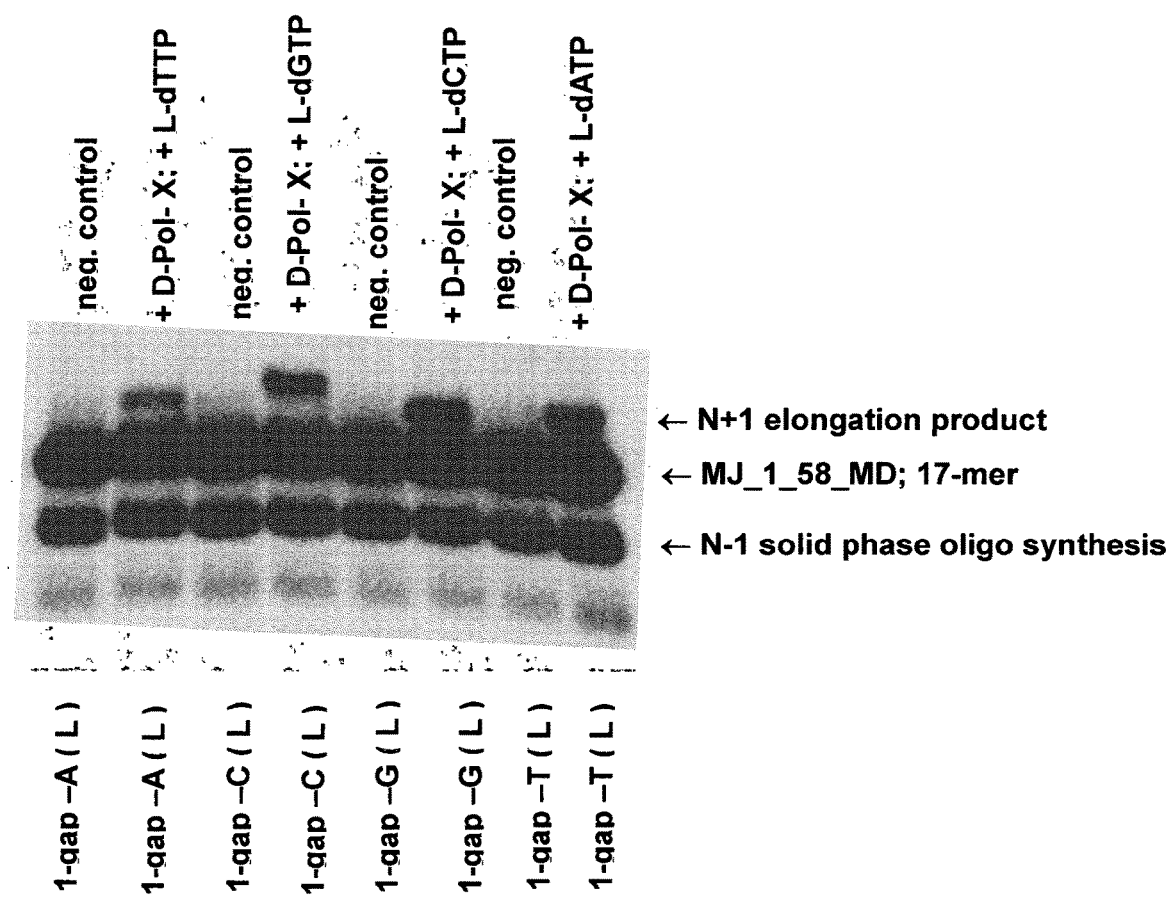
FIG. 8 shows gel electrophoresis of L-DNA elongation activity assay of D-polymerase X on 1-gap substrates.

As can be seen from FIG. 8, all-D polymerase X variant V80A gives elongation products on L-DNA 1-gap substrates, thus confirming the activity of the synthetic protein. Noteworthy, only all-D polymerase X variant V80A combined with L-substrate and L-dNTP's gave any elongation product. Also, only samples containing the L-dNTP corresponding to their template base yielded elongation product. That means on the A-complex the dTTP nucleotide, on the C-complex the dGTP nucleotide, on the G-complex the dCTP nucleotide and on the T-complex the dATP nucleotide had to be present to yield any elongation product.

4.2 Activity Assay on Substrates with 6-Nucleotide Gap

Substrates were made by annealing a 33-mer lower strand DNA oligonucleotide with two 17-mer and 12-mer upper strand DNA oligonucleotides resulting in a gap of 6 nucleotides in the upper strand. Oligonucleotides were synthesized in L-configuration. Before annealing, 17-mer upper strand oligonucleotide MJ_1_58_MD (L-configuration) was radioactively labeled at its 5'-end with $^{32}$P by a standard kinase reaction employing Gamma-$^{32}$P-Adenosine-Triphosphate (ATP) and T4 polynucleotide kinase. To facilitate the kinase reaction of the L-oligonucleotide MJ_1_58_MD, two D-configurated guanosine bases were added at the 5' end during oligonucleotide synthesis. Annealing was done in 10 mM Tris-HCl, 5 mM MgCl$_2$, pH 8.0 by heating 10 min at 65° C. and slowly cooling down. Unincorporated Gamma-$^{32}$P-ATP was removed by purification over NAP-columns (GE healthcare, Freiburg, Germany). For the setup of the substrate complexes see FIG. 9A.

In the activity assay synthetic all-D polymerase X variant V80A was combined with L-configurated 6-gap substrate complex. As a negative control, the substrate was also incubated without all-D polymerase X variant V80A and desoxy-nucleotide-triphosphates (L-dNTP's). A typical 6 µl assay contained 50 nM substrate complex, up to 1.3 ng/µl all-D polymerase X variant V80A, 8 µM each of the L-dNTP's and buffer (50 mM Tris-HCl, 10 mM MgCl$_2$, 4% glycerol, 0.1 mg/ml bovine serum albumin (BSA), pH 7.5). L-dNTP's were purchased as custom synthesis by Rasayan, Inc. (Encinitas, Calif., USA). A typical incubation time was 30 minutes at 37° C., but depending on activity of the batch longer incubations were used. The whole assay volume was mixed with sample buffer/dye, loaded on a denaturing sequencing gel a separated for 4 hours. The gel was exposed to Kodak K screen overnight at −80° C. and read out using BioRad Fx phosphoimager system.

As can be seen from FIG. 9B, synthetic all-D polymerase X variant V80A gives N+6 elongation products on L-DNA 6-gap substrates, thus confirming the activity of the synthetic protein. However, synthesis of N+6 elongation product was less evident than N+1 elongation product on the same 6-gap complex. Also increased incubation time was necessary to fill the 6-gap. Noteworthy, only all-D polymerase X variant V80A combined with L-substrate plus L-dNTP's gave any elongation product.

Example 5—DNA Synthesis by Polymerase X and Variants of Polymerase X

Polymerase X from African Swine Fever Virus (abbr. ASFV) is described in literature (Oliveros, 1997) as a highly distributive enzyme with gap-repair function. As shown in example 2 all-L-polymerase X and variants thereof has been shown to catalyze the incorporation of only very few nucleotides after each initiation on gapped substrates. Here we disclose a method which allows using all-L-polymerase X and variants for synthesizing longer DNA and show complete polymerization of a 83-mer strand.

5.1 Primer-Template Substrate

A primer-template complex has been used to test activity of all-L-polymerase X and variants thereof. The same complex has also been used to test variants V80G and V80A of the all-L-polymerase X.

List of D-oligonucleotides for the primer-template complex without gap:

| Name | Length, nt | Configuration | Sequence (5'→3') |
|---|---|---|---|
| MJ_1_33_DD | 19 | D | Atto532-GGAGCTCAGACTGGCACGC (SEQ ID NO: 47) |
| MJ_1_1_DD | 83 | D | GTGGAACCGACAACTTGTGCTGCGTCCAGCATAAGAAAGGAG CTCCCTCAGAAGAAGCTGCGCAGCGTGCCAGTCTGAGCTCC (SEQ ID NO: 48) |

Figure 10:
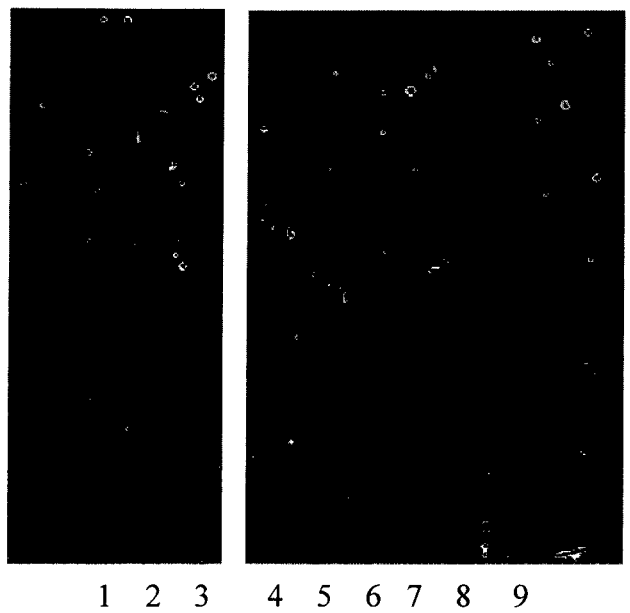
FIG. 10A shows primer-template complex D-DNA substrate for activity assay of L-polymerase X.
FIG. 10B shows gel electrophoresis of D-DNA elongation activity assay of L-polymerase X performed at constant temperature.
FIG. 10C shows gel electrophoresis of D-DNA elongation activity assay of L-polymerase X performed using thermal cycling.

The substrate was made by annealing a template strand DNA oligonucleotide consisting of 83 nucleotides (MJ_1_1_DD) with a DNA oligonucleotide consisting of 19 nucleotides. Oligonucleotides were synthesized at NOXXON. The oligonucleotide MJ_1_33_DD carries the fluorescent dye Atto-532 (AttoTec, Siegen, Germany). Annealing was done in 10 mM Tris-HCl, 5 mM MgCl2, pH 8.0 by heating 10 mM at 65° C. and slowly cooling down. The primer-template complex is depicted in FIG. 10A.

5.2 Reaction at Constant Temperature

In the activity assay, all-L-polymerase X or variants V80G or V80A of all-L-polymerase X were combined with D-configurated primer-template complex. A typical 6 µl assay contained 50 nM substrate complex, up to 1.3 ng/µl all-L-polymerase X or variants V80G or V80A of all-L-polymerase X, 8 µM each of the D-dNTP's and buffer (50 mM Tris-HCl, 10 mM MgCl$_2$, 4% glycerol, 0.1 mg/ml bovine serum albumin (BSA), pH 7.5). D-dNTP's were purchased from Rovalab (Teltow, Germany). Incubation time was 30 minutes at 37° C. for Pol-X samples. As a negative control, the substrate was also incubated without any all-L-polymerase X or variants V80G or V80A of all-L-polymerase X and without desoxy-nucleotide-triphosphates (D-dNTP's). A positive control was conducted with Taq polymerase (Invitrogen, Karlsruhe, Germany) used at final concentration of 0.083 U/µl in Taq buffer supplied by manufacturer. Taq samples were incubated 30 minutes at 60° C. The whole assay volume was mixed with sample buffer/dye, and separated on a denaturing gel. The gel was read out using BioRad Fx phosphoimager system.

All-L-polymerase X or variants V80G or V80A all-L-polymerase X were active, but were not able to complete the polymerization of the full 83-mer template. The Taq polymerase positive control shows complete polymerization of the 83-mer template, see FIG. 10B.

5.3 Reaction Under Thermal Cycling Conditions

Under the assumption that all-L-polymerase X after initiation catalyzes the incorporation of only one nucleotide and then pauses while staying on the DNA substrate, we performed repeated heat pulses (50° C., 2 minutes) in order to allow all-L-polymerase X for dissociation from and reassociation to the template. Using this repeated thermal cycling procedure we were able to perform full polymerization of the 83-mer with all-L-polymerase X. Reactions and controls were set-up as described above for constant temperature, except that the temperature profile for all-L-polymerase X samples was run as follows:

5 to 25 cycles of (30 minutes at 20° C./2 minutes at 50° C.)

then a final step of 30 minutes at 20° C.

It was observed that from 15 cycles onwards all-L-polymerase X was able to polymerize the full 83-mer template strand, similar to the positive control, see FIG. 10C.

Example 6—Primer Elongation with a Synthetic Polymerase X Variant Consisting of D-Amino Acids The method disclosed in this example uses L-configurated substrates for testing all-D configurated polymerase.

6.1 Primer-Template Substrate

List of L-oligonucleotides for the primer-template complex without gap:

| Name | Length, nt | Configuration | Sequence (5'→3') |
|---|---|---|---|
| MJ_1_109_MD | 21 | first two = D, others L | D(GG)-L(GGAGCTCAGACTGGCACGC) (SEQ ID NO: 49) |
| MJ_1_105_LD | 83 | L | GTGGAACCGACAACTTGTGCTGCGTCCAGCATAAGAAAGGAG CTCCCTCAGAAGAAGCTGCGCAGCGTGCCAGTCTGAGCTCC (SEQ ID NO: 23) |

The substrate is made by annealing a 83-mer lower strand DNA oligonucleotide with the 19-mer upper strand DNA oligonucleotide. Oligonucleotides are synthesized at NOXXON's in-house facility in L-configuration. Before annealing, 21-mer upper strand oligonucleotide MJ_1_109_MD is radioactively labeled at its 5'-end with $^{32}$P by a standard kinase reaction employing Gamma-$^{32}$P-Adenosine-Triphosphate (ATP) and T4 polynucleotide kinase. To facilitate the kinase reaction of the L-oligonucleotide MJ_1_109_MD, two D-configurated guanosine bases are added at the 5' end during oligonucleotide synthesis. Annealing is done in 10 mM Tris-HCl, 5 mM MgCl$_2$, pH 8.0 by heating 10 min at 65° C. and slowly cooling down. Unincorporated Gamma-$^{32}$P-ATP is removed by purification over NAP-columns (GE healthcare, Freiburg, Germany).

6.2 Reaction at Constant Temperature

In the activity assay, synthetic all-D polymerase X variant V80A is combined with L-configurated primer-template complex. A typical 6 μl assay contains 50 nM substrate complex, up to 1.3 ng/μl all-D polymerase X variant, 8 μM each of the L-dNTP's and buffer (50 mM Tris-HCl, 10 mM MgCl$_2$, 4% glycerol, 0.1 mg/ml bovine serum albumin (BSA), pH 7.5). L-dNTP's were purchased from Rasayan, Inc. (Encinitas, Calif., USA). Incubation time is at least 30 minutes at 37° C. As a negative control, the substrate is also incubated without any polymerase and without desoxy-nucleotide-triphosphates (L-dNTP's). The whole assay volume is mixed with sample buffer/dye, and separated on a denaturing gel. The gel is read out using BioRad Fx phosphoimager system.

The synthetic all-D polymerase X variant V80A is active under this condition, but—similar to the all-L polymerase X counterpart—is not able to polymerize the full 83 nucleotide template strand.

6.3 Reaction Under Thermal Cycling Conditions

Analog to example 5 a repeated thermal cycling procedure is used to allow for full polymerization of the 83-mer L-substrate with All-D Polymerase X variant V80A. Reactions and controls are set-up as described above for constant temperature, except that the temperature profile was run as follows:

5 to 25 cycles of (30 minutes at 20° C./2 minutes at 50° C.)

then a final step of 30 minutes at 20° C.

It is observed that all-D polymerase X variant V80A—similar to the all-L polymerase X counterpart—is able to polymerize the full 83-mer template strand when using thermal cycle elongation.

Example 7—Recombinant Expression and Purification of Polymerase Dpo4 and Variants of Polymerase Dpo4, all Consisting of L-Amino Acids The polymerase Dpo4 was originally discovered in *Sulfolobus Solfataricus* (abbr. Sso) (Boudsocq, 2001). The wild-type gene has an open reading frame (abbr. ORF) of 1,059 base pairs including start codon and stop codon. The encoded protein has a length of 352 amino acids. This example describes how polymerase Dpo4 and variants of polymerase Dpo4 have been expressed in *E. coli* and been purified using Strep-Tag.

7.1 Expression Constructs

Since the codon usage of Sso differs from *E. coli*, an *E. coli*-codon-optimized synthetic gene for wild-type Sso polymerase Dpo4 was purchased from GeneArt AG (Regensburg, Germany). The synthetic gene sequence was provided in pENTRY-IBA10 vector (originator company: IBA GmbH, Göttingen, Germany). The codon-optimized open reading frame including start codon, but not including stop codon had the following sequence:

```
                                      (SEQ ID NO: 50)
ATGATTGTGCTGTTTGTGGATTTTGATTATTTTTATGCCCAGGTGGAAGA

AGTTCTGAATCCGAGCCTGAAAGGTAAACCGGTTGTTGTTTGTGTTTTTA

GCGGTCGCTTTGAAGATAGCGGTGCAGTTGCAACCGCCAATTATGAAGCC

CGTAAATTTGGTGTTAAAGCCGGTATTCCGATTGTTGAAGCCAAAAAAAT

TCTGCCGAATGCAGTTTATCTGCCGATGCGCAAAGAAGTTTATCAGCAGG

TTAGCAGCCGTATTATGAATCTGCTGCGCGAATATAGCGAAAAAATTGAA

ATTGCCAGCATTGATGAAGCCTATCTGGATATTAGCGATAAAGTGCGCGA

TTATCGCGAAGCATATAATCTGGGCCTGGAAATTAAAAATAAAATCCTGG

AAAAAGAAAAAATTACCGTGACCGTGGGCATTAGCAAAAATAAAGTGTTT

GCCAAAATTGCAGCAGATATGGCAAAACCGAATGGCATTAAAGTGATTGA

TGATGAAGAAGTGAAACGTCTGATTCGCGAACTGGATATTGCAGATGTTC

CGGGTATTGGCAATATTACCGCAGAAAAACTGAAAAAACTGGGCATTAAT

AAACTGGTTGATACCCTGAGCATTGAATTTGATAAACTGAAAGGCATGAT

TGGTGAAGCGAAAGCCAAATATCTGATTAGCCTGGCACGTGATGAATATA

ATGAACCGATTCGTACCCGTGTTCGTAAAAGCATTGGTCGTATTGTGACC

ATGAAACGCAATAGCCGTAATCTGGAAGAAATTAAACCGTACCTGTTTCG

TGCAATTGAAGAAAGCTATTATAAACTGGATAAACGCATTCCGAAAGCCA

TTCATGTTGTTGCAGTTACCGAAGATCTGGATATTGTTAGCCGTGGTCGT

ACCTTTCCGCATGGTATTAGCAAAGAAACCGCCTATAGCGAAAGCGTTAA

ACTGCTGCAGAAAATCCTGGAAGAAGATGAACGTAAAATTCGTCGTATTG

GTGTGCGCTTTAGCAAATTTATTGAAGCCATTGGCCTGGATAAATTTTTT

GATACC.
```

In order to obtain the expression construct for polymerase Dpo4, also referred to as all-L-polymerase Dpo4, the gene was subcloned from pENTRY-IBA10 into the pASG-IBA5 vector (IBA GmbH, Göttingen, Germany), using a commercially available StarGate cloning kit (IBA GmbH). Subcloning added a Strep-Tag II to the N-terminus and a stop codon to the C-terminus, and brought the gene under control of the tet promoter. The construct was named pMJ343 and was used for expression of all-L-polymerase Dpo4 in *E. coli*. The all-L-polymerase Dpo4 expressed from pMJ343 had the following sequence of 368 amino acids:

```
                                      (SEQ ID NO: 51)
MASAWSHPQFEKSGMIVLFVDFDYFYAQVEEVLNPSLKGKPVVVCVFSGR

FEDSGAVATANYEARKFGVKAGIPIVEAKKILPNAVYLPMRKEVYQQVSS

RIMNLLREYSEKIEIASIDEAYLDISDKVRDYREAYNLGLEIKNKILEKE

KITVTVGISKNKVFAKIAADMAKPNGIKVIDDEEVKRLIRELDIADVPGI

GNITAEKLKKLGINKLVDTLSIEFDKLKGMIGEAKAKYLISLARDEYNEP

IRTRVRKSIGRIVTMKRNSRNLEEIKPYLFRAIEESYYKLDKRIPKAIHV

VAVTEDLDIVSRGRTFPHGISKETAYSESVKLLQKILEEDERKIRRIGVR

FSKFIEAIGLDKFFDTGS.
```

The initial 14 amino acids represented the Strep-Tag II including a few spacer amino acids, the final 2 amino acids represented spacer amino acids, and the middle 352 amino acid part was identical to the polymerase Dpo4 sequence as found in Sso.

Expression constructs for variants of all-L-polymerase Dpo4 were made using the commercially available QuikChange kit (Stratagene GmbH, Waldbronn, Germany) according to manufacturer's protocol. Plasmid pMJ343 served as template to make pMJ361, pMJ362, pMJ363, pMJ502, pMJ503 and pMJ504. Plasmid pMJ343 also served as template to make pMJ365 in two steps. Then pMJ365 served as template to make pMJ508, pMJ509, pJA95, pJA96, pJA100, pJA103 and pJA104. Then pMJ509 served as template to make pMJ511. Oligonucleotides needed for QuikChange were either synthesized at NOXXON (QC_38_up, QC_38_low, QC_39_up, QC_39_low, QC_40_up, QC_40_low, QC_41_up, QC_41_low, QC_dpo4_M76G_sense, QC_dpo4_M76G_antisense, QC_dpo4_M76A_sense, QC_dpo4_M76A_antisense, QC_dpo4_J67C_sense, QC_dpo4_J67C_antisense, QC_dpo4_S86G_sense, QC_dpo4_S86G_antisense) or purchased from Purimex (Grebenstein, Germany) (QC_28_up, QC_28_low, QC_29_up, QC_29_low, QC_30_up, QC_30_low).

The following variant expression constructs were made and used for expression of the variants of all-L-polymerase Dpo4 in *E. coli*

| variant | construct | oligonucleotides used for QuikChange mutagenesis procedure |
|---|---|---|
| A155C | pMJ361 | QC_28_up. (5'CAAAAATAAAGTGTTTGCCAAAATTGCATGCGATATGGCAAAACCG AATGGCATTAAAG 3') (SEQ ID NO: 52) QC_28_low (5'CTTTAATGCCATTCGGTTTTGCCATATCGCATGCAATTTTGGCAAA CACTTTATTTTTG 3') (SEQ ID NO: 53) |
| V203C | pMJ362 | QC_29_up (5'TGAAAAAACTGGGCATTAATAAACTGTGTGATACCCTGAGCATTGA ATTTG 3') (SEQ ID NO: 54) QC_29_low (5'-CAAATTCAATGCTCAGGGTATCACACAGTTTATTAATGCCCAGTTT TTTCA 3') (SEQ ID NO: 55) |
| C31S | pMJ363 | QC_30_up (5'TGAAAGGTAAACCGGTTGTTGTTTCTGTTTTTAGCGGTC 3') (SEQ ID NO: 56) QC_30_low (5'GACCGCTAAAAACAGAAACAACAACCGGTTTACCTTTCA 3') (SEQ ID NO: 57) |
| A155C + V203C | pMJ365 | QC_28_up QC_28_low QC_29_up QC_29_low |
| S85C | pMJ502 | QC_38_up (5'ATGCGCAAAGAAGTTTATCAGCAGGTTTGTAGCCGTATTATGAATC 3') (SEQ ID NO: 58) QC_38_low (5'GATTCATAATACGGCTACAAACCTGCTGATAAACTTCTTTGCGCAT-3') (SEQ ID NO: 59) |
| S86C | pMJ503 | QC_39_up (5'AAGTTTATCAGCAGGTTAGCTGTCGTATTATGAATCTGCTGCG 3') (SEQ ID NO: 60) QC_39_low (5'CGCAGCAGATTCATAATACGACAGCTAACCTGCTGATAAACTT 3') (SEQ ID NO: 61) |
| S96C | pMJ504 | QC_40_up (5'ATTATGAATCTGCTGCGCGAATATTGTGAAAAAATTGAAATTGCCA GCATT 3') (SEQ ID NO: 62) QC_40_low (5'AATGCTGGCAATTTCAATTTTTTCACAATATTCGCGCAGCAGATTC ATAAT 3') (SEQ ID NO: 63) |
| A71C + A155C + V203C | pMJ508 | QC_41_up (5'AGCCAAAAAAATTCTGCCGAATTGTGTTTATCTGCCGATGCGCAAA G 3') (SEQ ID NO: 353) QC_41_low (5'CTTTGCGCATCGGCAGATAAACACAATTCGGCAGAATTTTTTGGCT 3') (SEQ ID NO: 354) |
| S86C + A155C + V203C | pMJ509 | QC_39_up QC_39_low |
| C31S + S86C + A155C + V203C | pMJ511 | QC_30_up QC_30_low |
| M76G + | pJA95 | QC_dpo4_M76G_sense (5'CGAATGCAGTTTATCTGCCGGGGCGCAAAGAAGTTTATCAGC 3') |

| variant | construct | oligonucleotides used for QuikChange mutagenesis procedure |
|---|---|---|
| A155C + V203C | | (SEQ ID NO: 355) QC_dpo4_M76G_antisense (5'GCTGATAAACTTCTTTGCGCCCCGGCAGATAAACTGCATTCG 3') (SEQ ID NO: 356) |
| M76A + A155C + V203C | pJA96 | QC_dpo4_M76A_sense (5'-CGAATGCAGTTTATCTGCCGGCGCGCAAAGAAGTTTATCAGC 3') (SEQ ID NO: 357) QC_dpo4_M76A_antisense (5 ' GCTGATAAACTTCTTTGCGCGCCGGCAGATAAACTGCATTCG 3') (SEQ ID NO: 358) |
| I67C + A155C + V203C | pJA100 | QC_dpo4_I67C_sense (5'GGTATTCCGATTGTTGAAGCCAAAAAATGTCTGCCGAATGCAG 3') (SEQ ID NO: 359) QC_dpo4_I67C_antisense (5'CTGCATTCGGCAGACATTTTTTGGCTTCAACAATCGGAATACC 3') (SEQ ID NO: 360) |
| S86G + A155C + V203C | pJA103 | QC_dpo4_S86G_sense (5'GTTTATCAGCAGGTTAGCGGCCGTATTATGAATCTGC 3') (SEQ ID NO: 361) QC_dpo4_S86G_antisense (5'GCAGATTCATAATACGGCCGCTAACCTGCTGATAAAC 3') (SEQ ID NO: 362) |
| S96C + A155C + V203C | pJA104 | QC_40_up QC_40_low |

7.2 Protein Expression in E. coli

All-L-polymerase Dpo4 was expressed in E. coli using expression construct pMJ343. Mutant variants of all-L-polymerase Dpo4 were expressed from pMJ361, pMJ362, pMJ363, pMJ365, pMJ502, pMJ503, pMJ504, pMJ508, pMJ509, pMJ511, pJA95, pJA96, pJA100, pJA103 or pJA104. For expression, the appropriate expression construct was transformed in E. coli strain 'NEB express' (New England Biolabs, Frankfurt am Main, Germany) using 'Transformation and Storage Solution' (Epicentre/Biozym, Hessisch Oldendorf, Germany) and maintained with the antibiotic Ampicillin. Expression was done in medium 'EnBase Flo' or 'EnPresso' (BioSilta, Oulu, Finland) for 48 h at 30° C. using 200 ng/ml Anhydrotetracyclin (IBA GmbH, Göttingen, Germany) as inducer. Cells were harvested by centrifugation and either stored at −80° C. or immediately processed.

7.3 Protein Purification

Fresh or frozen E. coli cells were resuspended on ice in 'Buffer W' (100 mM Tris-HCl, pH 8.0, 150 mM NaCl, 1 mM EDTA) and lysed using a 'French Press' (G. Heinemann, Schwäbisch Gmünd, Germany) cell disrupter. Purification was done at 4° C. on an 'ÄKTA Express' system equipped with 5 ml StrepTrap HP columns (GE healthcare, Freiburg, Germany). Step elution was done with Buffer W including 2.5 mM Desthiobiotin (IBA GmbH, Göttingen, Germany). Fractions were analyzed using SDS-PAGE (Invitrogen, Karlsruhe, Germany), pooled and, if required, further purified with anion-ion-exchange chromatography on an 'ÄKTA purifier' system equipped with 'Q HP' columns (GE healthcare, Freiburg, Germany). Protein identity was confirmed by LC-MS mass spectometry and correct fractions were pooled, concentrated and re-buffered using VivaSpin 15R concentration devices with 10,000 molecular weight cut-off (MWCO) (VivaSciences/Sartorius Stedim Biotech, Göttingen, Germany). Purified protein was stored at −20° C. in a buffer consisting of 100 mM KCl, 10 mM Tris-HCl pH 7.4, 0.1 mM EDTA, 1 mM DTT, 50% glycerol. Protein concentrations were estimated by gel-densiometry using a bovine serum albumin (abbr. BSA) standard on SDS-PAGE and staining with SYPRO Red (Invitrogen, Karlsruhe, Germany).

Example 8—Production of a Synthetic Polymerase Dpo4 Consisting of Two Fragments

All-L polymerase Dpo4 has a length of 352 amino acids. In order to chemically produce the all-L polymerase Dpo4, such a synthetic all-L polymerase Dpo4 had to be assembled from shorter fragments that can be synthesized by solid-phase peptide synthesis, wherein said shorter fragments had to be ligated by a peptide ligation method such as the native chemical ligation. This example describes how ligation fragments 1-154, 155-352, 155-202 and 203-352 of Dpo4 have been expressed in E. coli, purified and ligated to each other by native chemical ligation to yield the synthetic all-L-polymerase Dpo4.

8.1 Expression Constructs

As disclosed in example 7 the gene for all-L-polymerase Dpo4 has been obtained as a synthetic gene construct from a commercial source (GeneArt, Regensburg, Germany). All fragments of this example were cloned based on that codon-optimized sequence. The following expression constructs for fragments 1-154, 155-352, 155-202 and 203-352 of the all-L-polymerase Dpo4 variant A155C were made:

| Fragment of Dpo4 (amino acid range) | expression construct |
|---|---|
| 1-154-thioester | pMJ370 |
| 155-352 contained A155C mutation | pMJ384 |

| Fragment of Dpo4 (amino acid range) | expression construct |
|---|---|
| 203-352 contained A155C mutation | pMJ385 |
| 155-202 thioester | pMJ388 |

8.1.1 Fragment 1-154-Thioester of all-L-Polymerase Dpo4 Variant A155C—Expression Construct pMJ370

This construct contains the fragment 1-154 of the all-L-polymerase Dpo4 variant A155C followed by an Mxe GyrA intein, which was used to produce the thioester, and a chitin-binding domain (CBD). The construct was assembled from two PCR products. PCR product 1 was made using pMJ343 as a template and primers MJ_1_90_DD (5'-Phosphate-AGCGGCTCTTCGATGATTGTGCTGTTTGTG-GATTTT-3', (SEQ ID NO: 64)) and MJ_1_91_DD (5'-Phosphate-AGCGGCTCTTCGGCATGCAATTTTGGCAAACACTTT-3', (SEQ ID NO: 65)) to amplify the fragment 1-154 of all-L-polymerase Dpo4 variant A155C. PCR product 2 was made using pTWIN1 (New England Biolabs, Frankfurt am Main, Germany) as a template and primers MJ_1_72_DD (5'-Phosphate-AGCGGCTCTTCGTGCATCACGG-GAGAT-3', (SEQ ID NO: 66)) and MJ_1_73_DD (5'-Phosphate-AGCGGCTCTTCGCCCTTGAAGCTGC-CACAAGGCAGGAACGTT-3', (SEQ ID NO: 67)) to amplify the Mxe Gyr A intein and the CBD. Primers MJ_1_90_DD and MJ_1_91_DD were from Purimex (Grebenstein, Germany) while primers MJ_1_72_DD and MJ_1_73_DD were from IBA GmbH (Göttingen, Germany). The two PCR products were gel-purified on a flash-gel system (LONZA, Basel, Switzerland) and cloned together in pENTRY-IBA20 using the StarGate Mutagenesis ENTRY cloning kit (IBA GmbH, Göttingen, Germany) to result in pMJ366. Subcloning from pMJ366 in pASG-IBAwt1 (IBA GmbH, Göttingen, Germany) using the StarGate Transfer cloning kit (IBA GmbH, Göttingen, Germany) yielded pMJ370. The construct pMJ370 encodes the fragment 1-154-thioester of all-L-polymerase Dpo4 variant A155C with the following protein sequence of 154 amino acids length (after intein cleavage/thioester production):

```
                                         (SEQ ID NO: 68)
MIVLFVDFDYFYAQVEEVLNPSLKGKPVVVCVFSGRFEDSGAVATANYEA

RKFGVKAGIPIVEAKKILPNAVYLPMRKEVYQQVSSRIMNLLREYSEKIE

IASIDEAYLDISDKVRDYREAYNLGLEIKNKILEKEKITVTVGISKNKVF

AKIA-thioester.
```

8.1.2 Fragment 155-352 of all-L-Polymerase Dpo4 Variant A155C—Expression Construct pMJ384

This construct contains a 'Profinity eXact' tag followed by the fragment 155-352 of all-L-polymerase Dpo4 variant A155C. The 'Profinity eXact' tag was used for purification and proteolytic cleavage. The construct was assembled from two PCR products. PCR product 1 was made using pPAL7 (Bio-Rad, München, Germany) as a template and primers MJ_1_99_DD (5'-Phosphate-AGCGGCTCTTCGATGG-GAGGGAAATCAAACGGGGAA-3', (SEQ ID: 69)) and MJ_1_100_DD (5'-Phosphate-AGCGGCTCTTCGGCACAAAGCTTT-GAAGAGCTTGTC-3', (SEQ ID: 70)) to amplify the 'Profinity eXact' tag. PCR product 2 was made using pMJ361 as a template and primers MJ_1_96_DD (5'-Phosphate-AGCGGCTCTTCGTGCGA-TATGGCAAAACCGAATGGCATTAAA-3', (SEQ ID: 71)) and MJ_1_97_DD (5'-Phosphate-AGCGGCTCTTCGCCCTTAGGTATCAAAAAATT-TATCCAGG-3', (SEQ ID: 72)) to amplify the dpo4 fragment 155-352 containing the A155C mutation. Primers MJ_1_96_DD, MJ_1_97_DD, MJ_1_99_DD and MJ_1_100_DD were all from Purimex (Grebenstein, Germany). The 2 PCR products were gel-purified on a flash-gel system (LONZA, Basel, Switzerland) and cloned together in pENTRY-IBA20 using the StarGate Mutagenesis ENTRY cloning kit (IBA GmbH, Göttingen, Germany) to result in pMJ382. Subcloning from pMJ382 in pASG-IBA5 (IBA GmbH, Göttingen, Germany) using the StarGate Transfer cloning kit (IBA GmbH, Göttingen, Germany) yielded pMJ384. The construct pMJ384 encodes the fragment 155-352 of all-L-polymerase Dpo4 containing mutation A155C with the following protein sequence of 198 amino acids length (after proteolytic cleavage):

```
                                         (SEQ ID NO: 73)
CDMAKPNGIKVIDDEEVKRLIRELDIADVPGIGNITAEKLKKLGINKL

VDTLSIEFDKLKGMIGEAKAKYLISLARDEYNEPIRTRVRKSIGRIVTM

KRNSRNLEEIKPYLFRAIEESYYKLDKRIPKAIHVVAVTEDLDIVSRGR

TFPHGISKETAYSESVKLLQKILEEDERKIRRIGVRFSKFIEAIGLDKF

FDT.
```

8.1.3 Fragment 203-352 of all-L-Polymerase Dpo4 Variant A155C—Expression Construct pMJ385

This construct contains a 'Profinity eXact' tag followed by the dpo4 fragment 203-352 containing mutation V203C. The 'Profinity eXact' tag was used for purification and proteolytic cleavage. The construct was assembled from two PCR products. PCR product 1 was made using pPAL7 (Bio-Rad, München, Germany) as a template and primers MJ_1_99_DD (5'-Phosphate-AGCGGCTCTTCGATGG-GAGGGAAATCAAACGGGGAA-3', (SEQ ID: 69)) and MJ_1_100_DD (5'-Phosphate-AGCGGCTCTTCGGCACAAAGCTTT-GAAGAGCTTGTC-3', (SEQ ID: 70)) to amplify the 'Profinity eXact' tag. PCR product 2 was made using pMJ362 as a template and primers MJ_1_98_DD (5'-Phosphate-AGCGGCTCTTCGTGTGATACCCTGAGCATT-GAATTT-3', (SEQ ID: 74)) and MJ_1_97_DD (5'-Phosphate-AGCGGCTCTTCGCCCTTAGGTATCAAAAAATTTATC CAGG-3', (SEQ ID: 72)) to amplify the dpo4 fragment 203-352 containing the V203C mutation. Primers MJ_1_97_DD, MJ_1_98_DD, MJ_1_99_DD and MJ_1_100_DD were all from Purimex (Grebenstein, Germany). The 2 PCR products were gel-purified on a flash-gel system (LONZA, Basel, Switzerland) and cloned together in pENTRY-IBA20 using the StarGate Mutagenesis ENTRY cloning kit (IBA GmbH, Göttingen, Germany) to result in pMJ383. Subcloning from pMJ383 in pASG-IBA5 (IBA GmbH, Göttingen, Germany) using the StarGate Transfer cloning kit (IBA GmbH, Göttingen, Germany) yielded pMJ385. The construct pMJ385 encodes the dpo4 fragment 203-352 V203C with the following protein sequence of 150 amino acids length (after proteolytic cleavage):

(SEQ ID NO: 73)
CDTLSIEFDKLKGMIGEAKAKYLISLARDEYNEPIRTRVRKSIGRIVT

MKRNSRNLEEIKPYLFRAIEESYYKLDKRIPKAIHVVAVTEDLDIVSRG

RTFPHGISKETAYSESVKLLQKILEEDERKIRRIGVRFSKFIEAIGLDK

FFDT 8.1.4 Fragment 155-202 of all-L-Polymerase Dpo4—Expression Construct pMJ388

This construct contains the dpo4 fragment 155-202 followed by an Mxe GyrA intein, which was used to produce the thioester, and a chitin-binding domain (CBD). The construct was assembled from two PCR products. PCR product 1 was made using pMJ343 as a template and primers MJ_1_101_DD (5'-Phosphate-AGCGGCTCTTC-GATGGCAGATATGGCAAAACCGAAT-3', (SEQ ID: 76)) and MJ_1_102_DD (5'-Phosphate-AGCGGCTCTTCGGCACAGTTTAT-TAATGCCCAGTTT-3', (SEQ ID: 77)) to amplify the dpo4 155-202 fragment. PCR product 2 was made using pTWIN1 (New England Biolabs, Frankfurt am Main, Germany) as a template and primers MJ_1_72_DD (5'-Phosphate-AGCGGCTCTTCGTGCATCACGGGAGAT-3', (SEQ ID: 66)) and MJ_1_73_DD (5'-Phosphate-AGCGGCTCTTCGCCCTTGAAGCTGC-CACAAGGCAGGAACGTT-3', (SEQ ID: 67)) to amplify the Mxe Gyr A intein and the CBD. Primers MJ_1_101_DD and MJ_1_102_DD were from Purimex (Grebenstein, Germany) while primers MJ_1_72_DD and MJ_1_73_DD were from IBA GmbH (Göttingen, Germany). The 2 PCR products were gel-purified on a flash-gel system (LONZA, Basel, Switzerland) and cloned together in pENTRY-IBA20 using the StarGate Mutagenesis ENTRY cloning kit (IBA GmbH, Göttingen, Germany) to result in pMJ386. Subcloning from pMJ386 in pASG-IBAwt1 (IBA GmbH, Göttingen, Germany) using the StarGate Transfer cloning kit (IBA GmbH, Göttingen, Germany) yielded pMJ388. The construct pMJ388 encodes the dpo4 fragment 155-202 with the following protein sequence of 48 amino acids length (after *E. coli* mediated cleavage of the initial Methionine and after intein cleavage/thioester production):

(SEQ ID NO: 78)
ADMAKPNGIKVIDDEEVKRLIRELDIADVPGIGNITAEKLKKLGINKL-
thioester 8.2 Protein Expression in *E. coli*

For expression, the appropriate expression construct was transformed in *E. coli* strain 'NEB express' (New England Biolabs, Frankfurt am Main, Germany) using 'Transformation and Storage Solution' (Epicentre/Biozym, Hessisch Oldendorf, Germany) and maintained with the antibiotic Ampicillin. Expression was done in medium 'EnBase Flo' or 'EnPresso' (BioSilta, Oulu, Finland) at ambient temperature, using 200 ng/ml Anhydrotetracyclin (IBA GmbH, Göttingen, Germany) as inducer during an overnight period. Cells were harvested by centrifugation and either stored at −80° C. or immediately processed.

8.3 Purification and Generation of a Thioester from Constructs pMJ370 and pMJ388 with Mxe Gyr A Intein Fresh or frozen *E. coli* cells were resuspended on ice in 'column buffer' (20 mM HEPES, pH 8.5, 500 mM NaCl) and lysed using a 'French Press' (G. Heinemann, Schwäbisch Gmünd, Germany) cell disrupter. Purification was done at 4° C. on an 'ÄKTA Express' system (GE healthcare, Freiburg, Germany) equipped with columns containing chitin binding beads (New Englands Biolabs, Frankfurt am Main, Germany). After applying cell lysate and washing with column buffer until baseline, the columns were incubated 20 hours at 4° C. with 50 mM 2-mercaptoethane sulfonate (abbr. MESNA) in column buffer to induce intein-mediated protein cleavage and thioester formation. Cleaved protein carrying thioester was washed out of the column with column buffer, concentrated and subjected to gelfiltration using BioGel P60 medium material (BioRad, München, Germany) in a buffer consisting of 5 mM Bis-Tris, pH 6.5, 250 mM NaCl. Protein concentrations were estimated by gel-densiometry using a bovine serum albumin (BSA) standard on SDS-PAGE and staining with SYPRO Red (Invitrogen, Karlsruhe, Germany). Protein identity and the presence of the thioester were confirmed by LC-MS mass spectrometry.

8.4 Purification and Proteolytic Cleavage from Construct pMJ384 with 'Profinity eXact' Tag Purification of fragment 155-352 of the all-L-polymerase Dpo4 variant A155C from pMJ384 was done as follows: Fresh or frozen *E. coli* cells were resuspended on ice in 'Buffer W' (100 mM Tris-HCl, pH 8.0, 150 mM NaCl, 1 mM EDTA) and lysed using a 'French Press' (G. Heinemann, Schwäbisch Gmünd, Germany) cell disrupter. Purification was done at 4° C. on an 'ÄKTA Express' system equipped with 5 ml StrepTrap HP columns (GE healthcare, Freiburg, Germany). Step elution was done with Buffer W including 2.5 mM Desthiobiotin (IBA GmbH, Göttingen, Germany). Eluted protein was subjected to buffer exchange in 'Profinity eXact elution buffer' (0.1 M Na-phosphate, pH 7.2, 0.1 M NaF) using a HiPrep 26/10 desalting column (GE healthcare, Freiburg, Germany) and then slowly pumped through a Profinity eXact column. The sample was concentrated, supplemented with Tris(2-carboxyethyl)phosphine) (TCEP) to 1 mM final concentration and applied to gelfiltration using a HiLoad 16/60 Superdex 75 prep grade column (GE healthcare, Freiburg, Germany) developed in a buffer consisting of 5 mM Bis-Tris, pH 6.5, 250 mM NaCl. Protein was concentrated and stored at −80° C. Protein concentrations were estimated by gel-densiometry using a bovine serum albumin (BSA) standard on SDS-PAGE and staining with SYPRO Red (Invitrogen, Karlsruhe, Germany). Protein identity was confirmed by LC-MS mass spectrometry.

8.5 Purification and Proteolytic Cleavage from Construct pMJ385 with 'Profinity eXact' Tag Purification of dpo4 fragment 203-352 V203C from pMJ385 was done as follows: Inclusion bodies were prepared and denatured as described in the 'i-FOLD Protein refolding system' manual (Novagen/Merck-Millipore, Darmstadt, Germany). Solubilized protein was subjected to buffer exchange into 'Buffer W' (100 mM Tris-HCl, pH 8.0, 150 mM NaCl, 1 mM EDTA) using Sephadex G-25 fine material (GE healthcare, Freiburg, Germany) and purified at 4° C. on an 'ÄKTA Express' system equipped with Strep-Trap HP columns (GE healthcare, Freiburg, Germany). Step elution was done with Buffer W including 2.5 mM Desthiobiotin (IBA GmbH, Göttingen, Germany). Eluted protein solution was supplemented with NaF to a final concentration of 0.1 M and Tris(2-carboxyethyl)phosphine) (TCEP) to a final concentration of 1 mM and then slowly pumped through a Profinity eXact column. Flowthrough was diluted 1:3 with deionized water and pH adjusted to 7.2 using HCl. The sample was further purified by cation-exchange-chromatography using HiTrap SP HP columns (GE healthcare, Freiburg, Germany) equilibrated in 'Buffer A' (50 mM Na-Phosphate, pH 7.2, 1 mM 2-mercaptoethanol). Step elution was done using 17%, 25% and 100% of 'Buffer B' (50 mM Na-Phosphate, pH 7.2, 1 M NaCl, 1 mM 2-mercaptoethanol). Fractions were pooled, concentrated and applied to gelfiltration using a HiLoad 16/60 Superdex 75 prep grade column (GE healthcare, Freiburg, Germany) developed in deionized water. Protein was shock frozen in liquid nitrogen and lyophilized. Protein concentrations were estimated by gel-densiometry using a bovine serum albumin (BSA) standard on SDS-PAGE and staining with SYPRO Red (Invitrogen, Karlsruhe, Germany). Protein identity was confirmed by LC-MS mass spectrometry.

8.6 Synthesis of Synthetic all-L-Polymerase Dpo4 Variant A155C by Native Chemical Ligation of the Fragments 1-154-Thioester and 155-352

The fragments 1-154-thioester and 155-352 of all-L-polymerase Dpo4 variant A155C were solved 50 µM in TRIS-buffer (pH 8.6) containing 2% Triton X100, 1% thiophenol and 5 mM tris(2-carboxyethyl)phosphine hydrochloride. The reaction mixture was shaken 72 h by room temperature. Afterwards the ligation success was analyzed by SDS-PAGE (FIG. 11A) and LC-ESI-mass spectrometry (RP18-column, gradient of ACN with 0.1% TFA in water with 0.1% TFA 5-95% in 20 min, FIG. 11B). A clear band was found in lane around 41 kDa indicating the full length polymerase. The theoretical molecular weight ($M_{theor}$=40223 Da) corresponds the observed molecular weight ($M_{obs}$=40265 Da) as shown by ESI-MS.

8.7 Synthesis of Fragment 155-352 by Native Chemical Ligation of the Fragments 155-202-Thioester and 203-352

The fragments 155-202-thioester and 203-352 V203C of all-L-polymerase Dpo4 were solved 0.2 M in TRIS-buffer (pH 8.6) containing 2% SDS, 1% thiophenol and 5 mM tris(2-carboxyethyl)phosphine hydrochloride. The reaction mixture was shaken 72 h by room temperature. Analysis of the ligation success was performed by SDS-PAGE (FIG. 20A) and LC-ESI-mass spectrometry (RP18-column, gradient of ACN with 0.1% TFA in water with 0.1% TFA 5-95% in 20 min, FIG. 20B). A clear band was found in lane 7 around 21.5 kDa indicating the ligation product. The theoretical molecular weight ($M_{theor}$=22749 Da) corresponds the observed molecular weight ($M_{obs}$=22769 Da) as shown by ESI-MS.

Example 9—Recombinant Expression and Purification of Truncated Forms of Polymerase Dpo4, all Consisting of L-Amino Acids The polymerase Dpo4 was originally discovered in *Sulfolobus Solfataricus* (abbr. Sso) (Boudsocq, 2001). The wild-type gene has an open reading frame (abbr. ORF) of 1,059 base pairs including start codon and stop codon. The encoded protein has a length of 352 amino acids. This example describes how truncated forms of polymerase Dpo4 have been expressed in *E. coli* and been purified using Strep-Tag.

9.1 Expression Constructs

Since the codon usage of Sso differs from *E. coli*, an *E. coli*-codon-optimized synthetic gene for wild-type Sso polymerase Dpo4 was purchased from GeneArt AG (Regensburg, Germany). Also, truncated versions with 3, 6 or 9 amino acids deleted from C-terminus were custom made by GeneArt. The synthetic gene sequences were provided in pASK-IBA5plus vector (originator company: IBA GmbH, Göttingen, Germany) which adds a Strep-Tag to the N-terminus. The truncation form of dpo4 with 3 amino acids deleted at the C-terminus was the longest variant expressed from this series of plasmids, named clone 3.C11 (variant Δ3) and had the following sequence of 368 amino acids (sequence shown from N- to C-terminus):

(SEQ ID NO: 363)
MASWSHPQFEKGAETAVPNSIVLFVDFDYFYAQVEEVLNPSLKGKPVVVC

VFSGRFEDSGAVATANYEARKFGVKAGIPIVEAKKILPNAVYLPMRKEVY

QQVSSRIMNLLREYSEKIEIASIDEAYLDISDKVRDYREAYNLGLEIKNK

ILEKEKITVTVGISKNKVFAKIAADMAKPNGIKVIDDEEVKRLIRELDIA

DVPGIGNITAEKLKKLGINKLVDTLSIEFDKLKGMIGEAKAKYLISLARD

EYNEPIRTRVRKSIGRIVTMKRNSRNLEEIKPYLFRAIEESYYKLDKRIP

KAIHVVAVTEDLDIVSRGRTFPHGISKETAYSESVKLLQKILEEDERKIR

RIGVRFSKFIEAIGLDKF.

The initial 20 amino acids represented the Strep-Tag II including a few spacer amino acids, the following sequence then represents *Sulfolobus solfataricus* Dpo4 amino acids 2-349. Other truncation forms described in this example have the same sequence at the N-terminus, but less amino acids at the C-terminus. For example, clone 9.C3 (variant Δ6) had 6 amino acids deleted and clone 2.F12 (variant Δ9) had 9 amino acids deleted from the C-terminus. Expression constructs for further truncations forms of Dpo4 were made using the commercially available QuikChange kit (Stratagene GmbH, Waldbronn, Germany) according to manufacturer's protocol. Clone 2.F12 (dpo4 with 9 amino acids C-terminally deleted in pASK-IBA5plus) served as template to make pCK58 and pCK59. Oligonucleotides needed for QuikChange were at NOXXON.

The following expression constructs were made and used for expression of the truncated forms of polymerase Dpo4 in *E. coli*

| variant | construct | comment |
|---|---|---|
| Δ3 | clone 3.C11 | from GeneArt |
| Δ6 | clone 9.C3 | from GeneArt |
| Δ9 | clone 2.F12 | from GeneArt |
| Δ12 | pCK58 | made using the following QuikChange oligonucleotides QC_35_up (5'TATTGGTGTGCGCTTTAGCAAATTTTAATAAGGTACCCGGG 3') (SEQ ID NO: 364) |

| variant | construct | comment |
|---------|-----------|---------|
|         |           | QC_35_low<br>(5'CCCGGGTACCTTATTAAAATTTGCTAAAGCGCACACCAATA 3')<br>(SEQ ID NO: 365) |
| Δ15     | pCK59     | QC_36_up<br>(5'GTATTGGTGTGCGCTTTTAATAAGGTACCCGGGG 3')<br>(SEQ ID NO: 366)<br>QC_36__low<br>(5'CCCCGGGTACCTTATTAAAAGCGCACACCAATAC 3')<br>(SEQ ID NO: 367) |

9.2 Protein Expression in *E. coli*

Truncated forms Δ3, Δ6, Δ9, Δ12 or Δ15 of Dpo4 were expressed in *E. coli* using expression construct based on pASK-IB5plus. For expression, the appropriate expression construct was transformed in *E. coli* strain 'NEB express' (New England Biolabs, Frankfurt am Main, Germany) using 'Transformation and Storage Solution' (Epicentre/Biozym, Hessisch Oldendorf, Germany) and maintained with the antibiotic Ampicillin. Expression was done in medium 'EnBase Flo' or 'EnPresso' (BioSilta, Oulu, Finland) for 48 h at 30° C. using 200 ng/ml Anhydrotetracyclin (IBA GmbH, Göttingen, Germany) as inducer. Cells were harvested by centrifugation and either stored at −80° C. or immediately processed.

9.3 Protein Purification

Fresh or frozen *E. coli* cells were resuspended on ice in 'Buffer W' (100 mM Tris-HCl, pH 8.0, 150 mM NaCl, 1 mM EDTA) and lysed using a 'French Press' (G. Heinemann, Schwäbisch Gmünd, Germany) cell disrupter. Purification was done at 4° C. on an 'ÄKTA Express' system equipped with 5 ml StrepTrap HP columns (GE healthcare, Freiburg, Germany). Step elution was done with Buffer W including 2.5 mM Desthiobiotin (IBA GmbH, Göttingen, Germany). Fractions were pooled and buffer-exchanged in 50 mM Na-phosphate, pH 7.2 using a HiPrep_26/10 column (GE healthcare, Freiburg, Germany). Then proteins samples were applied to 5 ml cation exchange columns HiTrap_SP_HP (GE healthcare, Freiburg, Germany) and eluted with a gradient up to 1 M NaCl in 50 mM Na-phosphate pH 7.2. Eluted peak fractions were collected, pooled and buffer exchanged in 20 mM Tris-HCl pH 7.4, 200 mM KCl, 0.2 mM EDTA. All important fractions were analyzed using SDS-PAGE (Invitrogen, Karlsruhe, Germany. Protein identity was confirmed by LC-MS mass spectometry. The final samples were concentrated using VivaSpin 15R concentration devices with 10,000 molecular weight cut-off (MWCO) (VivaSciences/Sartorius Stedim Biotech, Göttingen, Germany) and supplemented with one volume glycerol and DTT, so that the storage buffer consisted of 10 mM Tris-HCl pH 7.4, 100 mM KCl, 0.1 mM EDTA, 1 mM DTT, 50% glycerol. Purified protein was stored at −20° C. Protein concentrations were estimated by gel-densiometry using a bovine serum albumin (abbr. BSA) standard on SDS-PAGE and staining with SYPRO Red (Invitrogen, Karlsruhe, Germany).

Example 10—Activity Confirmation of Polymerase Dpo4 and Variants of Polymerase Dpo4 Consisting of L-Amino Acids This example describes a PCR activity test for all-L-polymerase Dpo4 and variants of all-L-polymerase Dpo4 according to example 7, for the synthetic all-L-polymerase Dpo4 according to example 8 and for truncated forms of Dpo4 according to example 9.

10.1 Templates for PCR Activity Assay

Template for the PCR reaction is a 83-mer single-stranded D-DNA oligonucleotide (MJ_1_1_DD) from which, in the first thermal cycle, the opposite strand is made. Thereafter both strands serve as template for exponential amplification. Template DNA oligonucleotide and DNA primers are synthesized at NOXXON in D-configuration.

List of Oligonucleotides for the PCR Activity Assay:

| Name | Length, nt | Sequence (5'→3') |
|------|------------|------------------|
| MJ_1_1_DD | 83 | GTGGAACCGACAACTTGTGCTGCGTCCAGCA<br>TAAGAAAGGAGCTCCCTCAGAAGAAGCTGCG<br>CAGCGTGCCAGTCTGAGCTCC<br>(SEQ ID NO: 48) |
| DE4.40T7 | 38 | TCTAATACGACTCACTATAGGAGCTCAGACT<br>GGCACGC (SEQ ID NO: 79) |
| DE4.40R | 20 | GTGGAACCGACAACTTGTGC<br>(SEQ ID NO: 80) |

10.2 PCR Reactions

15 µl PCR reactions contained 0.2 mM each of the four D-dNTP's, 10 nM 83-mer ssDNA (MJ_1_1_DD) template, 1 µM of forward and reverse primer, 1× ThermoPol buffer (Invitrogen, 20 mM Tris-HCl, 10 mM KCl, 10 mM $(NH_4)_2SO_4$, 2 mM $MgSO_4$, 0.1% Triton X-100, pH 8.8@25° C.) and at least 0.67 ng/µl all-L-polymerase Dpo4 or a variant of all-L-polymerase Dpo4 or the synthetic all-L-polymerase Dpo4. The forward primer is DE4.40T7, the reverse primer is DE4.40R, yielding a PCR product of 102 base pairs length. The D-dNTP's were purchased from Rovalab (Teltow, Germany). Negative controls were conducted by omitting all-L-polymerase Dpo4 or a variant of all-L-polymerase Dpo4 or the synthetic all-L-polymerase Dpo4. Positive controls were conducted using commercially available all-L-dpo4 (New England Biolabs, Frankfurt am Main, Germany).

The thermal cycling program consisted of 1 cycle (85° C., 3 min) then at least 7 cycles (85° C., 30 sec/56° C., 1 min/60° C., 4 min) then hold at 4° C. 4 µl aliquots of the PCR reactions were mixed with sample loading buffer and analyzed on TBE-PAGE or on agarose gels (LONZA, Cologne, Germany). A DNA standard ladder containing, among others, a 100 bp band was applied on the gel.

10.3 Activity Confirmation

All-L-polymerase Dpo4, the variants A155C, V203C, C31S, A155C/V203C, S85C, S86C, S96C, A71C/A155C/V203C, S86C/A155C/V203C, C31S/S86C/A155C/V203C, M76G/A155C/V203C, M76A/A155C/V203C, 167C/

A155C/V203C, S86G/A155C/V203C and S96C/A155C/V203C of all-L-polymerase Dpo4, and the C-terminally truncated forms Δ3, Δ6, Δ9, Δ12 and Δ15 of Dpo4, and the synthetic all-L-polymerase Dpo4 were tested. All tested polymerases were able to amplify the template strand in the PCR reaction. FIG. 12A shows the analysis of PCR reactions performed with the variants A155C, V203C, C31S, A155C/V203C of all-L-polymerase Dpo4, which showed a band in the range of about 100 bp as compared with the DNA standard ladder. Expected PCR product size was 102 base pairs. Said band does not appear in the negative controls, where polymerase is omitted. Also said 102 bp band migrates higher than the 83-mer template. FIG. 12B shows the analysis of PCR reactions performed with the recombinant all-L-polymerase dpo4 and with the synthetic all-L-polymerase dpo4 which was made by ligation of fragments. The gel showed bands in the range of about 100 bp as compared with the DNA standard ladder. Expected PCR product size was 102 base pairs. Said band is very weak in the negative controls, where polymerase is omitted. Recombinant all-L-polymerase dpo4 and synthetic all-L-polymerase dpo4 show comparable activity. FIG. 12C shows the analysis of PCR reactions performed with the recombinant all-L-polymerase dpo4 and with the variants A71C/A155C/V203C, S86C/A155C/V203C and C31S/S86C/A155C/V203C. The gel showed bands in the range of about 100 bp as compared with the DNA standard ladder. Expected PCR product size was 102 base pairs. FIG. 12D shows the analysis of PCR reactions performed with the recombinant all-L-polymerase dpo4 and with the variants M76G/A155C/V203C and M76A/A155C/V203C. The gel showed bands in the range of about 100 bp as compared with the DNA standard ladder. Expected PCR product size was 102 base pairs. FIG. 12E shows the analysis of PCR reactions performed with the variants I67C/A155C/V203C, S86G/A155C/V203C and S96C/A155C/V203C. The gel showed bands in the range of about 100 bp as compared with the DNA standard ladder. Expected PCR product size was 102 base pairs. FIG. 12F shows the analysis of PCR reactions performed with the C-terminally truncated forms Δ3, Δ6, Δ9, Δ12 and Δ15 of Dpo4. The gel showed bands in the range of about 100 bp as compared with the DNA standard ladder. Expected PCR product size was 102 base pairs.

Example 11—Synthesis of a Variant of Polymerase Dpo4 Consisting of D-Amino Acids Within the example the synthesis of the all-D polymerase Dpo variant A155C/V203C is described. The amino acid sequence of the all-D polymerase Dpo variant A155C/V203C is (SEQ ID NO: 18)
Ac-MIVLFVDFDYFYAQVEEVLNPSLKGKPVVVCVFSGRFEDSGAVATAN

YEARKFGVKAGIPIVEAKKILPNAVYLPMRKEVYQQVSSRIMNLLREYSE

KIEIASIDEAYLDISDKVRDYREAYNLGLEIKNKILEKEKITVTVGISKN

KVFAKIACDMAKPNGIKVIDDEEVKRLIRELDIADVPGIGNITAEKLKKL

GINKLCDTLSIEFDKLKGMIGEAKAKYLISLARDEYNEPIRTRVRKSIGR

IVTMKRNSRNLEEIKPYLFRAIEESYYKLDKRIPKAIHVVAVTEDLDIVS

RGRTFPHGISKETAYSESVKLLQKILEEDERKIRRIGVRFSKFIEAIGLD

KFFDT-OH.

All amino acids used are protected according to the Solid-phase peptide synthesis Fmoc/tBu-strategy requirements (Eric Atherton et al, 1981). All amino acids used are D-amino acids (Bachem, Bubendorf, Switzerland).

11.1 Synthesis of H-D-Met-OGp(Boc)$_2$ 1 mmol Z-D-Met-OH, 0.9 eq. TBTU and 0.9 mmol HO-Gp(Boc)$_2$ were dissolved in 10 ml DMF. After addition of 2 eq. DIPEA the solution was stirred for 2 hours. After evaporating the solvent the raw product was purified with flash chromatography using DCM. Pure fractions of Z-D-Met-OGp(Boc)$_2$ were combined and the solvent was evaporated.

Z-D-Met-OGp(Boc)$_2$ was dissolved in 10 ml MeOH and flushed with argon. Hydrolytic cleavage of the N-terminal Z-group was achieved by the addition of Pd/C catalyst and H$_2$ in 2 hours. After filtrating off H-D-Met-OGp(Boc)$_2$ MeOH was evaporated under reduced pressure. Analytics was performed using reversed phase HPLC and mass spectrometry. The calculated mass of 482 Da is in accordance to the determined mass of 483 Da.

11.2 Synthesis of Fully Protected All-D-Peptide H-

(1)
(SEQ ID NO: 81)
RTFPHGISKETAYSESVKLLQKILEEDERIURRIGVRFSKFIEAIGLDKF
FDT-NH$_2$ 0.1 mmol Fmoc-Sieber rink amide NovaSynTG resin was loaded after Fmoc-deprotection with Fmoc-D-Thr(tBu)-OH using 5 eq. amino acid, eq. 4.9 eq. HATU and 10 eq. DIPEA for 45 min in 6 ml NMP.

Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 42 amino acids.

The cleavage of the fully protected peptide acid was achieved by incubating the peptidyl resin twice in 10 ml 1% (v/v) TFA in DCM for 2 hours. After filtering off the peptide the solvent was evaporated and the residue precipitated using ice cold diethyl ether. The precipitated peptide was isolated and dried.

The final product was characterised by HPLC and mass spectrometry (FIG. 13). The calculated mass for the product (6244 Da) corresponds to the measured mass (6249 Da).

11.3 Synthesis of Fully Protected All-D-Peptide Boc- (2)
(SEQ ID NO: 82)
VDTLSIEFDKLKGMIGEAKAKYLISLARDEYNEPIRTRVRKSIGRIVTMK
RNSRNLEEIKPYLFRAIEESYYKLDKRIPKAIHVVAVTEDLDIVSRG-OH 0.10 mmol TentaGel-R-Trityl resin was loaded with Fmoc-D-Gly-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-Gly-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20%

(v/v) piperidine in NMP. Double coupling was performed after coupling of 39 amino acids.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried. The final product was characterised by HPLC and mass spectrometry (FIG. 14). The experimentally determined mass of the product (11289 Da) was in accordance to the theoretical value (11286 Da).

11.4 Synthesis of All-D-Peptide (3)
(SEQ ID NO: 83)
H-VDTLSIEFDKLKGMIGEAKAKYLISLARDEYNEPIRTRVRKSIGRIVT

MKRNSRNLEEIKPYLFRAIEESYYKLDKRIPKAIHVVAVTEDLDIVSRGR

TFPHGISKETAYSESVKLLQKILEEDERKIRRIGVRFSKFIEAIGLDKFF

DT-NH$_2$

By Fragment Condensation of Peptide 1 with Peptide 2.

5 µmole (2) and 1 eq. (1) were dissolved in 25% (v/v) TFE in DCM. After addition of 5 eq. PyBOP and 10 eq. DIPEA the mixture was stirred overnight. After evaporating the solvent the peptide was precipitated using ice cold diethyl ether and filtered off.

The cleavage of the side chain protection groups of the peptide was performed with 2.5% EDT, 2.5% water, 2.5% TIS in TFA for 2 hours. Following the evaporation of TFA the peptide was precipitated with ice cold diethyl ether. Reversed phase HPLC purification of the N-terminal Fmoc-protected peptide was performed on a C18 column using an ACN/water gradient. Fractions that contain product were combined and freeze dried.

The final product was characterised by HPLC and mass spectrometry (FIG. 15). The experimentally determined mass (17531 Da) corresponds to the theoretical molecular mass (17512 Da).

11.5 Synthesis of All-D-Peptide (4)
(SEQ ID NO: 84)
Z-CDMAKPNGIKVIDDEEVKRLIRELDIADVPGIGNITAEKLKKLGINKL-
benzyl-thioester 0.10 mmol TentaGel-R-Trityl resin was loaded with Fmoc-D-Leu-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Leu-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

The N-terminal Z- and completely side chain protected peptide 4 was solved 1 mM in DMF. After addition of 5 eq. PyBOP, 10 eq. DIPEA and 30 eq. benzyl mercaptan the mixture was stirred for 4 h. Then the DMF was evaporated, the peptide was precipitated and washed with ice-cold diethyl ether. The side chain protecting groups were removed by treatment with 2.5% EDT, 2.5% water, 2.5% TIS in TFA for 2 hours. After the evaporation of TFA the peptide was precipitated and washed with ice cold diethyl ether. The peptide-benzyl-thioester was then purified by reversed-phase HPLC and analyzed by reversed-phase HPLC (FIG. 16A) and ESI-MS (FIG. 16B). The theoretical molecular weight ($M_{theor}$=5527 Da) corresponds the observed molecular weight ($M_{obs}$=5533 Da) as shown by ESI-MS.

11.6 Synthesis of all-D-peptide (7)
(SEQ ID NO: 85)
H-RKEVYQQVSSRIMNLLREYSEKIEIASIDEAYLDISDKVRDYREAYNL
GLEIKNKILEKEKITVTVGISKNKVFAKIA-SMe 0.10 mmol TentaGel-R-NH$_2$ resin was loaded with Fmoc-D-Ala-OH using 5 eq. amino acid, eq. 4.9 eq. HATU and 10 eq. DIPEA for 45 min in 6 ml NMP. Subsequently the resin was washed with THF. Conversion to Fmoc-D-Ala-Ψ[CS-NH]-R-TentaGel was achieved by incubation with 4 eq. Lawesson reagent in THF at 80° C. for 2 hours. Following this the resin was washed with NMP. Subsequently the so prepared resin was used in automated peptide synthesis as described previously (ABI 433, FASTmoc protocol, 10 eq. amino acid were activated using 9 eq. HATU and 20 eq. DIPEA in NMP; coupling time was 45 min and Fmoc-deprotection was performed three times for 7 min with 20% (v/v) piperidine in NMP). Double coupling steps were performed after 44 coupled amino acids.

Following this the corresponding thioester was generated by incubation with methyl iodide in DMF overnight according to Sharma et al. (Sharma et al, 2011). After filtering of the resin the peptide thioester containing solvent was evaporated and the residue precipitated using ice cold diethyl ether. The cleavage of side chain protection groups was performed with 2.5% EDT, 2.5% water, 2.5% TIS in TFA for 2 hours. Following the evaporation of TFA the peptide was precipitated with ice cold diethyl ether. Reversed phase HPLC purification of the peptide thioester was performed on a C18 column using an ACN/water gradient. Fractions that contain product were combined and freeze dried.

The final product was characterised by HPLC (FIG. 17A) and mass spectrometry (FIG. 17B). The molecular mass of the product determined by mass spectrometry (9155 Da) was in accordance to the calculated mass (9150 Da).

11.7 Synthesis of (6)
(SEQ ID NO: 86)
Ac-MIVLFVDFDYFYAQVEEVLNPSLKGKPVVVCVFSGRFEDSGAVATAN
YEARKFGVKAGIPIVEAKKILPNAVYLPM-OGp 0.10 mmol TentaGel-R-Trityl resin was loaded with Fmoc-D-Pro-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Pro-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 46 amino acids. Acetylation of the N-terminus was performed with 10% (v/v) acetic anhydride and 10% (v/v) DIPEA in DMF three times for 10 min.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

0.01 mmol fully protected peptide, 4 eq. PyBOP and 5 eq. H-D-Met-OGp(Boc)$_2$ were dissolved in 6 ml NMP. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column using an ACN/water gradient. Fractions that contain product were combined and freeze dried.

The final product was characterised by HPLC (FIG. 18A) and mass spectrometry (FIG. 18B). The experimentally determined mass (8547 Da) corresponded to the theoretical molecular mass (8541 Da).

11.8 Synthesis of All-D-Peptide (5)

(SEQ ID NO: 87)
H-CDMAKPNGIKVIDDEEVKRLIRELDIADVPGIGNITAEKLKKLGINKL

CDTLSIEFDKLKGMIGEAKAKYLISLARDEYNEPIRTRVRKSIGRIVTMK

RNSRNLEEIKPYLFRAIEESYYKLDKRIPKAIHVVAVTEDLDIVSRGRTF

PHGISKETAYSESVKLLQKILEEDERKIRRIGVRFSKFIEAIGLDKFFD

T-OH

By Native Chemical Ligation of Peptide 4 with Peptide 3

Both peptides 3 and 4 are solved 0.2 M in TRIS-buffer (pH 8.6) containing 2% SDS, 1% thiophenol and 5 mM tris(2-carboxyethyl)phosphine hydrochloride. The reaction mixture shaked 72 h by room temperature. Afterwards the mixture is purified is by reversed-phase HPLC. For removal of the N-terminal Z-protecting group the peptide was solved in 270 eq. TFA and 50 eq. thioanisol and shakes for 6 h at room temperature (Yoshiaki Kiso et al, 1980). After evaporation of TFA the peptide was precipitated and washed by ice-cold diethyl ether and purified again by reversed-phase HPLC (Phenomenex, Aschaffenburg, Germany). Analysis of the free peptide 5 is performed by SDS-PAGE, reversed phase UPLC and ESI-mass spectrometry. The correct mass of the product is found.

11.9 Synthesis of All-D-Peptide (8)

(SEQ ID NO: 88)
Ac-MIVLFVDFDYFYAQVEEVLNPSLKGKPVVVCVFSGRFEDSGAVATAN

YEARKFGVKAGIPIVEAKKILPNAVYLPMRKEVYQQVSSRIMNLLREYSE

KIEIASIDEAYLDISDKVRDYREAYNLGLEIKNKILEKEKITVTVGISKN

KVFAKIA-SMe

By Protease-Catalyzed Ligation of Peptide 6 with Peptide 7

Peptide 6 was solved 0.2 mM and peptide 7 was solved 0.6 mM in sodium-phosphate buffer (100 mM, pH 8.5, with 100 mM NaCl) containing 4 M Urea. After addition of 20 µM Clostripain (Endoprotease Arg-C, Worthington Biochemical Corporation, Lakewood, N.J., USA) the reaction mixture was shaken overnight at 37° C. The precipitated peptides were centrifuged, solved in H$_2$O/Formic Acid 80/20 and will be purified by reversed phase HPLC using a RP-18-column (Phenomenex, Aschaffenburg, Germany) with a gradient of ACN in water of 5% to 95% within 30 min. The final peptide was analyzed by SDS-PAGE (FIG. 19A) and ESI-mass spectrometry (FIG. 19B). A band was found in lane 1 between 14.4 kDa and 21.5 kDa indicating the ligation product. The theoretical molecular weight of the ligation product ($M_{theor}$=17476 Da) corresponds the observed molecular weight ($M_{obs}$=17486 Da) as shown by ESI-MS.

11.10 Synthesis of the All-D Polymerase Dpo Variant A115C/V203C by Native Chemical Ligation of Peptide 8 with Peptide 5

Both peptides 5 and 8 are solved 0.2 M in TRIS-buffer (pH 8.6) containing 2% Triton X100, 1% thiophenol and 5 mM tris(2-carboxyethyl)phosphine hydrochloride. The reaction mixture shakes 72 h by room temperature. Afterwards the mixture is purified by reversed-phase HPLC and analyzed by SDS-PAGE, reversed phase UPLC and ESI-mass spectrometry. The correct mass of the ligation product is found.

Example 12—Synthesis of a Polymerase Dpo4 Variant A71C/A155C/V203C Consisting of D-Amino Acids Within the example the synthesis of the all-D polymerase Dpo variant A71C/A155C/V203C is described. The amino acid sequence of the all-D polymerase Dpo variant A71C/A155C/V203C is (SEQ ID NO: 94)
Ac-MIVLFVDFDYFYAQVEEVLNPSLKGKPVVVCVFSGRFEDSGAVATAN

YEARKFGVKAGIPIVEAKKILPNCVYLPMRKEVYQQVSSRIMNLLREYSE

KIEIASIDEAYLDISDKVRDYREAYNLGLEIKNKILEKEKITVTVGISKN

KVFAKIACDMAKPNGIKVIDDEEVKRLIRELDIADVPGIGNITAEKLKKL

GINKLCDTLSIEFDKLKGMIGEAKAKYLISLARDEYNEPIRTRVRKSIGR

IVTMKRNSRNLEEIKPYLFRAIEESYYKLDKRIPKAIHVVAVTEDLDIVS

RGRTFPHGISKETAYSESVKLLQKILEEDERKIRRIGVRFSKFIEAIGLD

KFFDT-NH$_2$.

123

All amino acids used are protected according to the *Solid-phase peptide synthesis* Fmoc/tBu-strategy requirements (Eric Atherton et al, 1981). All amino acids used are D-amino acids (Bachem, Bubendorf, Switzerland).

12.1 Synthesis of Fully Protected All-D-Peptide H-

(1)
(SEQ ID NO: 81)
RTFPHGISKETAYSESVKLLQKILEEDERKIRRIGVRFSKFIEAIGLDKF
FDT-NH2

0.1 mmol Fmoc-Sieber rink amide NovaSynTG resin was loaded after Fmoc-deprotection with Fmoc-D-Thr(tBu)-OH using 5 eq. amino acid, eq. 4.9 eq. HATU and 10 eq. DIPEA for 45 min in 6 ml NMP.

Automated synthesis was done using an ABI 433 synthesizer with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 42 amino acids.

The cleavage of the fully protected peptide acid was achieved by incubating the peptidyl resin twice in 10 ml 1% (v/v) TFA in DCM for 2 hours. After filtering off the resin the solvent was evaporated and the peptide was precipitated using ice cold diethyl ether. Finally the peptide was isolated and dried.

The final product was characterised by HPLC and mass spectrometry (FIG. 13). The calculated mass for the product (6244 Da) corresponds to the measured mass (6249 Da).

12.2 Synthesis of Fully Protected All-D-Peptide (3)
(SEQ ID NO: 368)
Boc-CDTLSIEF DKLKGMIGEA
KAKYLISLAR DEYNEPIRTR VRKSIGRIVT MKRNSRNLEE
IKPYLFRAIE ESYYKLDKRI PKAIHVVAVT EDLDIVSRG-OH 0.10 mmol TentaGel-R-Trityl resin was loaded with Fmoc-D-Gly-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-Gly-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling steps were performed after coupling of 39 amino acids.

The identity of the synthesized peptide was characterised after TFA cleavage of a small amount of peptidyl resin by HPLC and mass spectrometry (FIG. 14). The experimentally determined mass of the product (11289 Da) was in accordance to the theoretical value (11286 Da).

The cleavage of the fully protected peptide acid was achieved by incubating the peptidyl resin twice in 10 ml 1% (v/v) TFA in DCM for 2 hours. After filtering off the resin the solvent was evaporated and the peptide was precipitated using ice cold diethyl ether. Finally the peptide was isolated and dried.

124

12.3 Synthesis of All-D-Peptide (5)
(SEQ ID NO: 369)
H-CDTLSIEFDKLKGMIGEAKAKYLISLARDEYNEPIRTRVRKSIGRIVT

MKRNSRNLEEIKPYLFRAIEESYYKLDKRIPKAIHVVAVTEDLDIVSRGR

TFPHGISKETAYSESVKLLQKILEEDERKIRRIGVRFSKFIEAIGLDKFF

DT-NH2

By Fragment Condensation of Peptide 1 with Peptide 3.

5 μmole (3) and 1 eq. (1) were dissolved in 25% (v/v) TFE in DCM. After addition of 5 eq. PyBOP and 10 eq. DIPEA the mixture was stirred overnight. After evaporating the solvent the peptide was precipitated using ice cold diethyl ether and filtered off.

The cleavage of the side chain protection groups of the peptide was performed with 2.5% EDT, 2.5% water, 2.5% TIS in TFA for 2 hours. Following the evaporation of TFA the peptide was precipitated with ice cold diethyl ether. Reversed phase HPLC purification of the N-terminal Fmoc-protected peptide was performed on a C18 column using an ACN/water gradient. Fractions that contain product were combined and freeze dried.

The final product was characterised by HPLC and mass spectrometry (FIG. 15). The experimentally determined mass (17531 Da) corresponds to the theoretical molecular mass (17512 Da).

12.4 Synthesis of All-D-Peptide (9)
(SEQ ID NO: 344)
H-CVYLPMRKEVYQQVSSRIMNLLREYSEKIEIASIDEAYLDISDKVRDY
REAYNLGLEIKNKILEKEKITVTVGISKNKVFAKIA-SBz1

0.10 mmol TentaGel-R-Trityl resin was loaded with Fmoc-D-Ala-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Ala-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 44 amino acids. Acetylation of the N-terminus was performed with 10% (v/v) acetic anhydride and 10% (v/v) DIPEA in DMF three times for 10 min.

The cleavage of the fully protected peptide acid was achieved by incubating the peptidyl resin twice in 10 ml 30% (v/v) HFIP in DCM for 2 hours. After filtering off the resin the solvent was evaporated and the residue precipitated using ice cold diethyl ether. The precipitated peptide was isolated and dried.

0.005 mmol fully protected peptide, 5 eq. PyBOP and 100 eq. benzylmercaptan were dissolved in 6 ml DCM. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column using an ACN/water gradient. Fractions that contain exclusively product were combined and freeze dried.

The final product was characterised by UPLC (FIG. 21) and mass spectrometry (FIG. 22). The molecular mass of the product determined by mass spectrometry (9926 Da) was in accordance to the calculated mass (9923 Da).

12.5 Synthesis of

(11)
(SEQ ID NO: 345)
Ac-MIVLFVDFDYFYAQVEEVLNPSLKGKPVVVCVFSGRFEDSGAVATAN
YEARKFGVKAGIPIVEAKKILPN-SBzl 0.10 mmol TentaGel-R-Trityl resin was loaded with Fmoc-D-Asn(Trt)-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Asn(Trt)-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 40 amino acids. Acetylation of the N-terminus was performed with 10% (v/v) acetic anhydride and 10% (v/v) DIPEA in DMF three times for 10 min.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

0.005 mmol fully protected peptide, 5 eq. PyBOP and 100 eq. benzylmercaptane were dissolved in 6 ml DCM. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column using an ACN/water gradient. Fractions that contain exclusively product were combined and freeze dried.

The final product was characterised by UPLC (FIG. 23) and mass spectrometry (FIG. 24). The molecular mass of the product determined by mass spectrometry (7848 Da) was in accordance to the calculated mass (7845 Da).

12.6 Synthesis of All-D-Peptide (7)
(SEQ ID NO: 84)
Z-CDMAKPNGIKVIDDEEVKRLIRELDIADVPGIGNITAEKLKKLGINKL-
benzyl-thioester 0.10 mmol TentaGel-R-Trityl resin was loaded with Fmoc-D-Leu-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Leu-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

The N-terminal Z- and completely side chain protected peptide 4 was solved 1 mM in DMF. After addition of 5 eq. PyBOP, 10 eq. DIPEA and 30 eq. benzyl mercaptan the mixture was stirred for 4 h. Then the DMF was evaporated, the peptide was precipitated and washed with ice-cold diethyl ether. The side chain protecting groups were removed by treatment with 2.5% EDT, 2.5% water, 2.5% TIS in TFA for 2 hours. After the evaporation of TFA the peptide was precipitated and washed with ice cold diethyl ether. The peptide-benzyl-thioester was then purified by reversed-phase HPLC and analyzed by reversed-phase UPLC (FIG. 25 A) and ESI-MS (FIG. 25 B). The theoretical molecular weight ($M_{theor}$=5527 Da) corresponds the observed molecular weight ($M_{obs}$=5534 Da) as shown by ESI-LC-MS.

12.7 Synthesis of All-D-Peptide (8)
(SEQ ID NO: 375)
H-CDMAKPNGIKVIDDEEVKRLIRELDIADVPGIGNITAEKLKKLGINKL

CDTLSIEFDKLKGMIGEAKAKYLISLARDEYNEPIRTRVRKSIGRIVTMK

RNSRNLEEIKPYLFRAIEESYYKLDKRIPKAIHVVAVTEDLDIVSRGRTF

PHGISKETAYSESVKLLQKILEEDERKIRRIGVRFSKFIEAIGLDKFFD

T-$NH_2$

By Native Chemical Ligation of Peptide 7 with Peptide 5.

Both peptides 5 and 7 were solved 0.2 M in sodium-phosphate-buffer (100 mM, with 100 mM NaCl, pH 8) containing 2% Triton X100, 1% thiophenol and 5 mM tris(2-carboxyethyl)phosphine hydrochloride. The reaction mixture was shaken 48 h by room temperature. Afterwards the mixture was purified by reversed-phase HPLC on a RP-8-column (Vydac 208 TP, Grace GmbH & Co KG, Worms, Germany) by using a gradient of 30% to 80% ACN/methanol 1:1 in water/1% TFA within 30 min. Fractions containing product were pooled and purified in a second step by size exclusion chromatography on a Yarra 3u SEC-2000-column (Phenomenex, Aschaffenburg, Germany) using a 50 mM sodium-phosphate-buffer, pH 6, as mobile phase. After removal of salts in water/1% formic acid using a HiTrap desalting-column 5 ml (GE Healthcare GmbH, München, Germany) the peptide product fractions were freeze dried. For removal of the N-terminal Z-protecting group the peptide was solved in 270 eq. TFA and 50 eq. thioanisol and shaken for 6 h at room temperature (Yoshiaki Kiso et al, 1980). After evaporation of TFA the peptide was precipitated and washed by ice-cold diethyl ether. Analysis of the free peptide 8 was performed by SDS-PAGE (FIG. 26 A) and ESI-LC-mass spectrometry (FIG. 26 B). A band was found in between the 20 kDa-band and the 25 kDa-band of the marker indicating the ligation product. The theoretical molecular weight of the ligation product ($M_{theor}$=22781 Da) corresponds the observed molecular weight ($M_{obs}$=22796 Da) as shown by ESI-LC-MS.

12.8 Synthesis of All-D-Peptide (11)

(SEQ ID NO: 346)
Ac-MIVLFVDFDYFYAQVEEVLNPSLKGKPVVVCVFSGRFEDSGAVATA

NYEARKFGVKAGIPIVEAIUULPNCVYLPMRKEVYQQVSSRIMNLLREY

SEKIEIASIDEAYLDISDKVRDYREAYNLGLEIKNKILEKEKITVTVGI

SKNKVFAKIA-SBzl

By Native Chemical Ligation of Peptide 10 with Peptide 9

Peptide 10 and peptide 9 were solved 0.5 mM in sodium-phosphate buffer (100 mM, pH 8, with 100 mM NaCl) containing 6 M guanidine-HCl, 5 mM tris(2-carboxyethyl) phosphine hydrochloride and 2% thiophenol. The reaction mixture was shaken for 72 h at room temperature. Hereupon the thiophenol-precipitate was centrifuged and the supernatant was purified by size exclusion chromatography using an Agilent SEC-3-column (Agilent Technologies Deutschland GmbH, Böblingen, Germany) and 6 M guanidine-HCl in 50 mM sodium-phosphate-buffer pH 6 as mobile phase. Fractions containing peptide were afterwards desalted in water/1% formic acid at a HiTrap desalting-column 5 ml (GE Healthcare GmbH, München, Germany). After freeze drying fractions were analyzed by SDS-PAGE (FIG. 27 A) and ESI-LC-mass-spectrometry (FIG. 27 B). A band was found in lanes 3 to 6 between the 15 kDa-band and 20 kDa-band of the marker indicating the ligation product. The theoretical molecular weight of the ligation product ($M_{theor}$=17641 Da) corresponds the observed molecular weight ($M_{obs}$=17641 Da) as shown by ESI-LC-MS.

12.9 Synthesis of the All-D Polymerase Dpo4 Variant A71C/A155C/V203C by Native Chemical Ligation of Peptide 11 with Peptide 8

Both peptides 11 and 8 were solved 50 µM in sodium-phosphate-buffer (pH 8, 100 mM with 100 mM NaCl) containing 2% Triton X100, 1% thiophenol and 5 mM tris(2-carboxyethyl)phosphine hydrochloride. The reaction mixture was shaken 72 h by room temperature. Afterwards the reaction mixture was analyzed by SDS-PAGE (FIG. 28 A+B) and ESI-LC-mass spectrometry (FIG. 28 C). A band was found in lane 3 of the coomasie-stained gel (A) and in the corresponding lane of the silver-stained gel (B) between the 37 kDa-band and 50 kDa-band of the marker and in the exact high of the native L-Dpo4 indicating the ligation product. The theoretical molecular weight of the ligation product ($M_{theor}$=40298 Da) corresponds the observed molecular weight ($M_{obs}$=40945 Da) as shown by ESI-MS (C). The by 647 Da higher measured mass may be caused by a Triton X-100 adduct.

Example 13—Synthesis of Polymerase Dpo4 Variant M76G/A155C/V203C Consisting of D-Amino Acids Within the example the synthesis of the all-D polymerase Dpo variant M76G/A155C/V203C is described. The amino acid sequence of the all-D polymerase Dpo variant M76G/A155C/V203C is (SEQ ID NO: 97)
Ac-MIVLFVDFDYFYAQVEEVLNPSLKGKPVVVCVFSGRFEDSGAVATA

NYEARKFGVKAGIPIVEAKKILPNAVYLPGRKEVYQQVSSRIMNLLREY

SEKIEIASIDEAYLDISDKVRDYREAYNLGLEIKNKILEKEKITVTVGI

SKNKVFAKIACDMAKPNGIKVIDDEEVKRLIRELDIADVPGIGNITAEK

LKKLGINKLCDTLSIEFDKLKGMIGEAKAKYLISLARDEYNEPIRTRVR

KSIGRIVTMKRNSRNLEEIKPYLFRAIEESYYKLDKRIPKAIHVVAVTE

DLDIVSRGRTFPHGISKETAYSESVKLLQKILEEDERKIRRIGVRFSKF

IEAIGLDKFFDT-NH2.

All amino acids used are protected according to the *Solid-phase peptide synthesis* Fmoc/tBu-strategy requirements (Eric Atherton et al, 1981). All amino acids used are D-amino acids (Bachem, Bubendorf, Switzerland).

13.1 Synthesis of H-Gly-OGp(Boc)$_2$ 1 mmol Z-Gly-OH, 0.9 eq. TBTU and 0.9 mmol HO-Gp (Boc)$_2$ were dissolved in 10 ml DMF. After addition of 2 eq. DIPEA the solution was stirred for 2 hours. After evaporating the solvent the raw product was purified with flash chromatography using DCM:EE 9:1. Pure fractions of Z-Gly-OGp(Boc)$_2$ were combined and the solvent was evaporated. Z-Gly-OGp(Boc)$_2$ was dissolved in 10 ml MeOH and flushed with argon. Hydrolytic cleavage of the N-terminal Z-group was achieved by the addition of Pd/C catalyst and H$_2$ in 2 hours. After filtrating off the catalyst the solvent was evaporated under reduced pressure. Analytics were performed using reversed phase HPLC and mass spectrometry. The calculated mass of 408 Da is in accordance to the experimentally determined mass of 409 Da.

13.2 Synthesis of Fully Protected All-D-Peptide H-R TFPHGISKET AYSESVKLLQ KILEEDERKI RRIGVRFSKF IEAIGLDKFF DT-NHS (1)(SEQ. ID. NO:81)

0.1 mmol Fmoc-Sieber rink amide NovaSynTG resin was loaded after Fmoc-deprotection with Fmoc-D-Thr(tBu)-OH using 5 eq. amino acid, eq. 4.9 eq. HATU and 10 eq. DIPEA for 45 min in 6 ml NMP.

Automated synthesis was done using an ABI 433 synthesizer with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 42 amino acids.

The cleavage of the fully protected peptide acid was achieved by incubating the peptidyl resin twice in 10 ml 1% (v/v) TFA in DCM for 2 hours. After filtering off the resin the solvent was evaporated and the peptide was precipitated using ice cold diethyl ether. Finally the peptide was isolated and dried.

The final product was characterised by HPLC and mass spectrometry (FIG. 13). The calculated mass for the product (6244 Da) corresponds to the measured mass (6249 Da).

13.3 Synthesis of Fully Protected All-D-Peptide (3)

(SEQ ID NO: 368)
Boc-CDTLSIEF DKLKGMIGEA
KAKYLISLAR DEYNEPIRTR VRKSIGRIVT MKRNSRNLEE
IKPYLFRAIE ESYYKLDKRI PKAIHVVAVT EDLDIVSRG-OH 0.10 mmol TentaGel-R-Trityl resin was loaded with Fmoc-Gly-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-Gly-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling steps were performed after coupling of 39 amino acids.

The identity of the synthesized peptide was characterised after TFA cleavage of a small amount of peptidyl resin by HPLC and mass spectrometry (FIG. 14). The experimentally determined mass of the product (11289 Da) was in accordance to the theoretical value (11286 Da).

The cleavage of the fully protected peptide acid was achieved by incubating the peptidyl resin twice in 10 ml 1% (v/v) TFA in DCM for 2 hours. After filtering off the resin the solvent was evaporated and the peptide was precipitated using ice cold diethyl ether. Finally the peptide was isolated and dried.

13.4 Synthesis of All-D-Peptide (5)

(SEQ ID NO: 369)
H-CDTLSIEFDKLKGMIGEAKAKYLISLARDEYNEPIRTRVRKSIGRIV

TMKRNSRNLEEIKPYLFRAIEESYYKLDKRIPKAIHVVAVTEDLDIVSR

GRTFPHGISKETAYSESVKLLQKILEEDERKIRRIGVRFSKFIEAIGLD

KFFDT-NH₂

By Fragment Condensation of Peptide 1 with Peptide 3.

5 μmole (3) and 1 eq. (1) were dissolved in 25% (v/v) TFE in DCM. After addition of 5 eq. PyBOP and 10 eq. DIPEA the mixture was stirred overnight. After evaporating the solvent the peptide was precipitated using ice cold diethyl ether and filtered off.

The cleavage of the side chain protection groups of the peptide was performed with 2.5% EDT, 2.5% water, 2.5% TIS in TFA for 2 hours. Following the evaporation of TFA the peptide was precipitated with ice cold diethyl ether. Reversed phase HPLC purification of the N-terminal Fmoc-protected peptide was performed on a C18 column using an ACN/water gradient. Fractions that contain product were combined and freeze dried.

The final product was characterised by HPLC and mass spectrometry (FIG. 15). The experimentally determined mass (17531 Da) corresponds to the theoretical molecular mass (17512 Da).

13.5 Synthesis of All-D-Peptide (9)

(SEQ ID NO: 348)
H-RKEVYQQVSSRIMNLLREYSEKIEIASIDEAYLDISDKVRDYREAYNL
GLEIKNKILEKEKITVTVGISKNKVFAKIA-SBzl 0.10 mmol TentaGel-R-Trityl resin was loaded with Fmoc-D-Ala-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Ala-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 44 amino acids. Acetylation of the N-terminus was performed with 10% (v/v) acetic anhydride and 10% (v/v) DIPEA in DMF three times for 10 min.

The cleavage of the fully protected peptide acid was achieved by incubating the peptidyl resin twice in 10 ml 30% (v/v) HFIP in DCM for 2 hours. After filtering off the resin the solvent was evaporated and the residue precipitated using ice cold diethyl ether. The precipitated peptide was isolated and dried.

0.005 mmol fully protected peptide, 5 eq. PyBOP and 100 eq. benzylmercaptan were dissolved in 6 ml DCM. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column using an ACN/water gradient. Fractions that contain exclusively product were combined and freeze dried.

The final product was characterised by UPLC (FIG. 29) and mass spectrometry (FIG. 30). The molecular mass of the product determined by mass spectrometry (9217 Da) was in accordance to the calculated mass (9217 Da).

13.6 Synthesis of (10)

(SEQ ID NO: 347)
Ac-MIVLFVDFDY FYAQVEEVLNP SLKGKPVVV CVFSGRFEDS
GAVATANYEA RKFGVKAGIP IVEAKKILPN AVYLPG-OGp 0.10 mmol TentaGel-R-Trityl resin was loaded with Fmoc-D-Pro-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Pro-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. Double coupling was performed after coupling of 45 amino acids. Acetylation of the N-terminus was performed with 10% (v/v) acetic anhydride and 10% (v/v) DIPEA in DMF three times for 10 min.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

0.005 mmol fully protected peptide, 5 eq. PyBOP and 10 eq. H-Gly-OGp(Boc)₂ were dissolved in 6 ml DCM. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT, 2.5% water, 2.5% TIS in TFA for 2 hours. Following the evaporation of TFA the peptide was precipitated with ice cold diethyl ether. Reversed phase HPLC purification of the peptide ester was performed on a C18 column using an ACN/water gradient. Fractions that contain product were combined and freeze dried.

The final product was characterised by UPLC (FIG. 31) and mass spectrometry (FIG. 32). The molecular mass of the product determined by mass spectrometry (8481 Da) was in accordance to the calculated mass (8473 Da).

13.7 Synthesis of All-D-Peptide (7)
(SEQ ID NO: 84)
Z-CDMAKPNGIKVIDDEEVKRLIRELDIADVPGIGNITAEKLKKLGINKL-
benzyl-thioester 0.10 mmol TentaGel-R-Trityl resin was loaded with Fmoc-D-Leu-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Leu-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

The N-terminal Z- and completely side chain protected peptide 4 was solved 1 mM in DMF. After addition of 5 eq. PyBOP, 10 eq. DIPEA and 30 eq. benzyl mercaptan the mixture was stirred for 4 h. Then the DMF was evaporated, the peptide was precipitated and washed with ice-cold diethyl ether. The side chain protecting groups were removed by treatment with 2.5% EDT, 2.5% water, 2.5% TIS in TFA for 2 hours. After the evaporation of TFA the peptide was precipitated and washed with ice cold diethyl ether. The peptide-benzyl-thioester was then purified by reversed-phase HPLC and analyzed by reversed-phase UPLC (FIG. 25A) and ESI-MS (FIG. 25B). The theoretical molecular weight ($M_{theor}$=5527 Da) corresponds the observed molecular weight ($M_{obs}$=5534 Da) as shown by ESI-LC-MS.

13.8 Synthesis of All-D-Peptide (8)
(SEQ ID NO: 375)
H-CDMAKPNGIKVIDDEEVKRLIRELDIADVPGIGNITAEKLKKLGINK

LCDTLSIEFDKLKGMIGEAKAKYLISLARDEYNEPIRTRVRKSIGRIVT

MKRNSRNLEEIKPYLFRAIEESYYKLDKRIPKAIHVVAVTEDLDIVSRG

RTFPHGISKETAYSESVKLLQKILEEDERKIRRIGVRFSKFIEAIGLDK

FFDT-NH$_2$

By Native Chemical Ligation of Peptide 7 with Peptide 5

Both peptides 5 and 7 were solved 0.2 M in sodium-phosphate-buffer (100 mM, with 100 mM NaCl, pH 8) containing 2% Triton X100, 1% thiophenol and 5 mM tris(2-carboxyethyl)phosphine hydrochloride. The reaction mixture was shaken 48 h by room temperature. Afterwards the mixture was purified by reversed-phase HPLC on a RP-8-column (Vydac 208 TP, Grace GmbH & Co KG, Worms, Germany) by using a gradient of 30% to 80% ACN/methanol 1:1 in water/1% TFA within 30 min. Fractions containing product were pooled and purified in a second step by size exclusion chromatography on a Yana 3u SEC-2000-column (Phenomenex, Aschaffenburg, Germany). The peptide product fractions were freeze dried. For removal of the N-terminal Z-protecting group the peptide was solved in 270 eq. TFA and 50 eq. thioanisol and shaken for 6 h at room temperature (Yoshiaki Kiso et al, 1980). After evaporation of TFA the peptide was precipitated and washed by ice-cold diethyl ether. Analysis of the free peptide 8 was performed by SDS-PAGE (FIG. 26A) and ESI-LC-mass spectrometry (FIG. 26B). A band was found in between the 20 kDa-band and the 25 kDa-band of the marker indicating the ligation product. The theoretical molecular weight of the ligation product ($M_{theor}$=22781 Da) corresponds the observed molecular weight ($M_{obs}$=22796 Da) as shown by ESI-LC-MS.

13.9 Synthesis of All-D-Peptide

(11)
(SEQ ID NO: 349)
Ac-MIVLFVDFDYFYAQVEEVLNPSLKGKPVVVCVFSGRFEDSGAVATAN

YEARKIFGVKAGIPIVEAIUULPNAVYLPGRKEVYQQVSSRIMNLLREYS

EKIEIASIDEAYLDISDKVRDYREAYNLGLEIKNKILEKEKITVTVGISK

NKVFAKIA-SBzl

By Protease-Catalyzed Ligation of Peptide 10 with Peptide 9.

Peptide 10 was solved 0.2 mM and peptide 9 was solved 0.6 mM in sodium-phosphate buffer (100 mM, pH 8, with 100 mM NaCl) containing 4 M Urea. After addition of 20 µM Clostripain (Endoprotease Arg-C, Worthington Biochemical Corporation, Lakewood, N.J., USA) the reaction mixture was shaken overnight at 37° C. Hereupon 6 M guanidine-HCl were added and the mixture was purified by size exclusion chromatography using an Agilent SEC-3-column (Agilent Technologies Deutschland GmbH, Böblingen, Germany) with 6 M guanidine-HCl in 50 mM sodium-phosphate-buffer pH 6 as mobile phase. Fractions containing peptide were afterwards desalted in water/1% formic acid at a HiTrap desalting column 5 ml (GE Healthcare GmbH, München, Germany). After freeze drying fractions were analyzed by SDS-PAGE (FIG. 33A) and ESI-LC-mass-spectrometry. (FIG. 33B). A band was found in lanes 3 and 4 between 15 kDa and 20 kDa indicating the ligation product. The theoretical molecular weight of the ligation product ($M_{theor}$=17612 Da) corresponds the observed molecular weight ($M_{obs}$=17641 Da) as shown by ESI-MS.

13.10 Synthesis of the All-D Polymerase Dpo4 Variant M76G/A155C/V203C by Native Chemical Ligation of Peptide 11 with Peptide 8

Both peptides 11 and 8 are solved 0.2 M in TRIS-buffer (pH 8.6) containing 2% Triton X100, 1% thiophenol and 5 mM tris(2-carboxyethyl)phosphine hydrochloride. The reaction mixture shakes 72 h by room temperature. Afterwards the mixture is purified by reversed-phase HPLC and analyzed by SDS-PAGE, reversed phase UPLC and ESI-mass spectrometry. The correct mass of the ligation product is found.

Example 14—Synthesis of Polymerase Dpo4 Variant A71C/A155C/V203C Consisting of D-Amino Acids by an Alternative Synthesis Strategy Within the example the synthesis of the all-D polymerase Dpo variant A71C/A155C/V203C is described. The amino acid sequence of the all-D polymerase Dpo variant A71C/A155C/V203C is

```
                                           (SEQ ID NO: 94)
Ac-MIVLFVDFDYFYAQVEEVLNPSLKGKPVVVCVFSGRFEDSGAVATAN

YEARKFGVKAGIPIVEAKKILPNCVYLPMRKEVYQQVSSRIMNLLREYSE

KIEIASIDEAYLDISDKVRDYREAYNLGLEIKNKILEKEKITVTVGISKN

KVFAKIACDMAKPNGIKVIDDEEVKRLIRELDIADVPGIGNITAEKLKKL

GINKLCDTLSIEFDKLKGMIGEAKAKYLISLARDEYNEPIRTRVRKSIGR

IVTMKRNSRNLEEIKPYLFRAIEESYYKLDKRIPKAIHVVAVTEDLDIVS

RGRTFPHGISKETAYSESVKLLQKILEEDERKIRRIGVRFSKFIEAIGLD

KFFDT-NH2.
```

All amino acids used are protected according to the *Solid-phase peptide synthesis* Fmoc/tBu-strategy requirements (Eric Atherton et al, 1981). All amino acids used are D-amino acids (Bachem, Bubendorf, Switzerland).

14.1 Synthesis of Fully Protected All-D-Peptide H-

```
(1)
                                          (SEQ ID NO: 350)
KAIHVVAVTEDLDIVSRGRTFPHGISKETAYSESVKLLQKILEEDERKIR
RIGVRFSKFIEAIGLDKFFDT-NH2
```

0.1 mmol Fmoc-Sieber rink amide NovaSynTG resin was loaded after Fmoc-deprotection with Fmoc-D-Thr(tBu)-OH using 5 eq. amino acid, eq. 4.9 eq. HATU and 10 eq. DIPEA for 45 min in 6 ml NMP.

Automated synthesis was done using an ABI 433 synthesizer with the FASTmoc protocol. 10 eq. amino acid were activated using 9 eq. HATU and 20 eq. DIPEA in NMP. Coupling time was 45 min and Fmoc-deprotection was performed three times for 7 min with 20% piperidine (v/v) in NMP. Double coupling was performed after coupling of 42 amino acids.

The cleavage of the fully protected peptide acid was achieved by incubating the peptidyl resin twice in 10 ml 1% TFA (v/v) in DCM for 2 hours. After filtering off the resin the solvent was evaporated and the peptide was precipitated using ice cold diethyl ether. Finally the peptide was isolated and dried.

The final product was characterised by HPLC and mass spectrometry (FIG. 34). The calculated mass for the product (8148 Da) corresponds to the measured mass (8156 Da).

14.2 Synthesis of Fully Protected All-D-Peptide

```
(3)
                                          (SEQ ID NO: 351)
H-CDTLSIEF DKLKGMIGEA KAKYLISLAR DEYNEPIRTR
VRKSIGRIVT MKRNSRNLEE IKPYLFRAIE ESYYKLDKRI
P-OH
```

0.10 mmol TentaGel-R-Trityl resin was loaded with Fmoc-D-Pro-Ol-1 as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Pro-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% piperidine (v/v) in NMP. Double coupling steps were performed after coupling of 40 amino acids. The N-terminal Cystein derivative was Boc-D-Cys(Trt)-OH.

The identity of the synthesized peptide was characterised after TFA cleavage of a small amount of peptidyl resin by HPLC and mass spectrometry (FIG. 35). The experimentally determined mass of the product (9393 Da) was in accordance to the theoretical value (9382 Da).

The cleavage of the fully protected peptide acid was achieved by incubating the peptidyl resin twice in 10 ml 1% TFA (v/v) in DCM for 2 hours. After filtering off the resin the solvent was evaporated and the peptide was precipitated using ice cold diethyl ether. Finally the peptide was isolated and dried.

14.3 Synthesis of All-D-Peptide

```
(5)
                                          (SEQ ID NO: 369)
H-CDTLSIEFDKLKGMIGEAKAKYLISLARDEYNEPIRTRVRKSIGRIVT

MKRNSRNLEEIKPYLFRAIEESYYKLDKRIPKAIHVVAVTEDLDIVSRGR

TFPHGISKETAYSESVKLLQKILEEDERKIRRIGVRFSKFIEAIGLDKFF

DT-NH2
```

By Fragment Condensation of Peptide 1 with Peptide 3.

5 µmole (3) and 1 eq. (1) were dissolved in 25% TFE (v/v) in DCM. After addition of 5 eq. PyBOP and 10 eq. DIPEA the mixture was stirred overnight. After evaporating the solvent the peptide was precipitated using ice cold diethyl ether and filtered off.

The cleavage of the side chain protection groups of the peptide was performed with 2.5% EDT (v/v), 2.5% water (v/v), 2.5% TIS (v/v) in TFA for 2 hours. Following the evaporation of TFA the peptide was precipitated with ice cold diethyl ether. Reversed phase HPLC purification of the N-terminal Fmoc-protected peptide was performed on a C18 column using an ACN/water gradient. Fractions that contain product were combined and freeze dried.

The final product was characterised by HPLC and mass spectrometry (FIG. 36). The experimentally determined mass (17529 Da) corresponds to the theoretical molecular mass (17512 Da).

14.4 Synthesis of all-D-Peptide (9)

(SEQ ID NO: 352)
H-CVYLPMRKEVYQQVSSRIMNLLREYSEKIEIASIDEAYLDISDKVRDY
REAYNLGLEIKNKILEKEKITVTVGISKNKVFAKIA-NHNH$_2$ 0.10 mmol TentaGel-R-Trityl resin was loaded with hydrazide as described in Zheng et al. (Zheng et al., 2013). Therefore 0.10 mmol resin was incubated twice for 30 min with 0.6 mmol thionylchloride and subsequently washed with DCM and 50% DMF (v/v) in DCM. Following this the resin was incubated twice for 30 min with 5% NH$_2$NH$_2$ (v/v) in DMF. Afterwards the resin was blocked three times for 10 min using a solution of 10% MeOH (v/v), 10% DIPEA (v/v) in DCM and washed with DCM. Coupling of the first amino acid was achieved by incubating the resin for one hour with 1 mmol Fmoc-D-Ala-OH, 0.9 mmol HATU, 2 mmol DIPEA dissolved in NMP. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% piperidine (v/v) in NMP. Double coupling was performed after coupling of 43 amino acids.

The cleavage of the peptide hydrazide from the resin was achieved by incubating the peptidyl resin in 2.5% EDT (v/v), 2.5% water (v/v), 2.5% TIS (v/v) in TFA for 2 hours. Following the evaporation of TFA the peptide was precipitated with ice cold diethyl ether. Reversed phase HPLC purification of the peptide ester was performed on a C18 column using an ACN/water gradient. Fractions that contain exclusively product were combined and freeze dried.

The final product was characterised by UPLC (FIG. 37 A) and mass spectrometry (FIG. 37 B). The molecular mass of the product determined by mass spectrometry (9843 Da) was in accordance to the calculated mass (9830 Da).

14.5 Synthesis of (11)

(SEQ ID NO: 345)
Ac-MIVLFVDFDYFYAQVEEVLNPSLKGKPVVVCVFSGRFEDSGAVATAN
YEARKFGVKAGIPIVEAKKILPN-SBzl 0.10 mmol TentaGel-R-Trityl resin was loaded with Fmoc-D-Asn(Trt)-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Asn(Trt)-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% piperidine (v/v) in NMP. Double coupling was performed after coupling of 40 amino acids. Acetylation of the N-terminus was performed with 10% acetic anhydride (v/v) and 10% DIPEA (v/v) in DMF three times for 10 min.

The cleavage of the fully protected peptide acid was achieved by incubating the peptidyl resin twice in 10 ml 30% HFIP (v/v) in DCM for 2 hours. After filtering off the peptide the solvent was evaporated and the residue precipitated using ice cold diethyl ether. The precipitated peptide was isolated and dried.

0.005 mmol fully protected peptide, 5 eq. PyBOP and 100 eq. benzylmercaptane were dissolved in 6 ml DCM. After addition of 10 eq. DIPEA the mixture was stirred for 4 hours. Following this the solvent was reduced evaporated and the residue precipitated by ice cold diethyl ether. The precipitated peptide ester was dried and subsequently protection groups were cleaved off using 2.5% EDT (v/v), 2.5% water (v/v), 2.5% TIS (v/v) in TFA for 2 hours. Following the evaporation of TFA the peptide was precipitated with ice cold diethyl ether. Reversed phase HPLC purification of the peptide ester was performed on a C18 column using an ACN/water gradient. Fractions that contain exclusively product were combined and freeze dried.

The final product was characterised by UPLC (FIG. 23) and mass spectrometry (FIG. 24). The molecular mass of the product determined by mass spectrometry (7848 Da) was in accordance to the calculated mass (7845 Da).

14.6 Synthesis of All-D-Peptide (7)

(SEQ ID NO: 370)
lipo-CDMAKPNGIKVIDDEEVKRLIRELDIADVPGIGNITAEKLKKLGI
NKL-4-acetamidothiophenylester 0.10 mmol TentaGel-R-Trityl resin was loaded with Fmoc-D-Leu-OH as described in Barlos et al. (Barlos et al., 1989). Therefore 0.10 mmol resin was incubated twice for 30 min with 0.6 mmol thionylchloride and subsequently washed with DCM. Following this the resin was incubated 90 min with 0.6 mmol Fmoc-D-Leu-OH, 2.4 mmol DIPEA in 6 ml DCM. Afterwards the resin was blocked three times for 10 min using a solution of 10% MeOH (v/v), 10% DIPEA (v/v) in DCM and washed with DCM. Automated synthesis was done using an ABI 433 with the FASTmoc protocol. 10 eq. amino acid were activated using 9 eq. HATU and 20 eq. DIPEA in NMP. Coupling time was 45 min and Fmoc-deprotection was performed three times for 7 min with 20% (v/v) piperidine in NMP. After the final coupling step Fmoc-deprotection was carried out. The lipo tag was introduced by incubating the resin with 10 eq. 4-Nitrophenyl-2-(octadecylsulfonyl)ethylcarbonate, 10 eq. HOBt and 10 eq. DIPEA in NMP overnight according to Garcia-Echeverria (Garcia-Echeverria, C. 1995). Following this the resin was washed with NMP and DCM.

The cleavage of the fully protected peptide acid was achieved by incubating the peptidyl resin twice in 10 ml 30% (v/v) HFIP in DCM for 2 hours. After filtering off the peptide the solvent was evaporated and the residue precipitated using ice cold diethyl ether. The precipitated peptide was isolated and dried.

0.05 mmol N-terminal lipo- and completely side chain protected peptide 4 was dissolved in DCM. After addition of 5 eq. PyBOP, 10 eq. DIPEA and 30 eq. 4-Acetamidothiophenol the mixture was stirred for 4 h. Then the DCM was evaporated, the peptide was precipitated and washed with ice-cold diethyl ether. The side chain protecting groups were removed by treatment with 2.5% EDT (v/v), 2.5% water (v/v), 2.5% TIS (v/v) in TFA for 2 hours. After the evaporation of TFA the peptide was precipitated and washed with ice cold diethyl ether. The peptide-4-acetamidothiophenylester was then purified by reversed-phase HPLC and analyzed by reversed-phase UPLC and mass spectrometry. The theoretical molecular weight ($M_{theor}$=5844) corresponds the observed molecular weight ($M_{obs}$=5847) as shown by ESI-LC-MS.

14.7 Synthesis of All-D-Peptide (8)
(SEQ ID NO: 375)
H-CDMAKPNGIKVIDDEEVKRLIRELDIADVPGIGNITAEKLKKLGINKL

CDTLSIEFDKLKGMIGEAKAKYLISLARDEYNEPIRTRVRKSIGRIVTMK

RNSRNLEEIKPYLFRAIEESYYKLDKRIPKAIHVVAVTEDLDIVSRGRTF

PHGISKETAYSESVKLLQKILEEDERKIRRIGVIZFSKFIEAIGLDKFFD

T-NH$_2$

By Native Chemical Ligation of Peptide 7 with Peptide 5.

Both peptides 5 and 7 were dissolved 2 mM in sodium-phosphate-buffer (200 mM, 6 M guanidine HCl, pH 8) containing 200 mM Mercaptophenylacetic acid and 50 mM tris(2-carboxyethyl)phosphine hydrochloride. The reaction mixture was shaken 24 h by room temperature. Afterwards the mixture was purified by reversed-phase HPLC on a RP-4-column (Jupiter 5 μm, 300 Å, Phenomenex, Aschaffenburg, Germany) by using a gradient of 30% to 95% ACN (0.1% TFA) within 30 min. Fractions containing product were combined and freeze dried. Cleavage of the lipo tag was achieved by incubating the dried product with 10% NH$_4$OH in TFE overnight according to Garcia-Echeverria (Garcia-Echeverria, C. 1995). Purification of the final product was carried out using the same HPLC conditions as described above. The theoretical molecular weight of the ligation product ($M_{theor}$=22781 Da) corresponds the observed molecular weight ($M_{obs}$=22796 Da) as shown by ESI-LC-MS.

14.8 Synthesis of All-D-Peptide

(11)
(SEQ ID NO: 371)
Ac-MIVLFVDFDYFYAQVEEVLNPSLKGKPVVVCVFSGRFEDSGAVATAN

YEARKFGVKAGIPIVEAKKILPNCVYLPMRKEVYQQVSSRIMNLLREYSE

KIEIASIDEAYLDISDKVRDYREAYNLGLEIKNKILEKEKITVTVGISKN

KVFAKIA-NHNH$_2$

By Native Chemical Ligation of Peptide 10 with Peptide 9

Peptide 10 and peptide 9 were solved 2 mM in sodium-phosphate buffer (200 mM, 6 M guanidine-HCl, pH 8) containing 200 mM Mercaptophenylacetic acid and 50 mM tris(2-carboxyethyl)phosphine hydrochloride. The reaction mixture was shaken for 24 h at room temperature. HPLC-purification was carried out using a C4 column (Jupiter 5 μm, 300 Å, Phenomenex, Aschaffenburg, Germany) and a gradient of 30-95% ACN (0.1% TFA) in 30 min. Product containing fractions were combined and freeze dried. The theoretical molecular weight of the ligation product ($M_{theor}$=17641 Da) corresponds the observed molecular weight ($M_{obs}$=17641 Da) as shown by ESI-LC-MS.

14.9 Synthesis of the All-D Polymerase Dpo4 Variant A71C/A155C/V203C by Native Chemical Ligation of Peptide 11 with Peptide 8

Oxidation of the hydrazide functionality of peptide 11, transformation into a thioester and native chemical ligations is done according to Zheng et al. (Zheng et al., 2013). Peptide 11 is dissolved 2 mM in sodium-phosphate-buffer (200 mM, 6 M guanidine-HCl, pH 3) and placed in a −15° C. ice-bath. Oxidation is achieved by adding NaNO$_2$ to give a final concentration of 50 mM. After 15 min the solution is mixed with a 2 mM solution of peptide 8 in sodium-phosphate-buffer (200 mM, 6 M guanidine-HCl, pH 8) containing 200 mM Mercaptophenylacetic acid and 50 mM TCEP.

The reaction mixture is shaken 24 h by room temperature. Afterwards the reaction mixture is analyzed by SDS-PAGE and ESI-LC-mass spectrometry.

Example 15—Activity Confirmation of Synthetic Polymerase Dpo4 Consisting of D-Amino Acids This example describes a PCR activity test for all-D polymerase Dpo4 variants A155C/V203C, A71C/A155C/V203C and M76G/A155C/V203C according to examples 11, 12, 13 and 14, wherein all-D polymerase Dpo4 variant A71C/A155C/V203C can be produced the synthesis and ligation according to example 13 or 14.

Surprisingly, the synthetic all-D polymerase Dpo4 variants A155C/V203C, A71C/A155C/V203C and M76G/A155C/V203C are active without extra refolding efforts and thus is used without further refolding procedure. Protein concentration is estimated by sodium dodecyl sulphate (abbr. SDS) polyacrylamide gel electrophoresis (abbr. PAGE) on pre-cast gels (Invitrogen, Karlsruhe, Germany) using a standard series of known protein concentrations followed by SYPRO-RED staining (Invitrogen, Karlsruhe, Germany) and densiometric band analysis on a BioRad Fx scanner instrument.

14.1 Templates for PCR Activity Assay

Template for the PCR reaction is a 83-mer single-stranded L-DNA oligonucleotide (MJ_1_105_LD) from which, in the first thermal cycle, the opposite strand is made. Thereafter both strands serve as template for exponential amplification. Template DNA oligonucleotide and DNA primers are synthesized at NOXXON in L-configuration.

List of oligonucleotides for PCR activity assay:

| Name | Length, nt | Configuration | Sequence (5'→3') |
|---|---|---|---|
| MJ_1_105_LD | 83 | L | GTGGAACCGACAACTTGTGCTGCGTCCAGCATAAGA AAGGAGCTCCCTCAGAAGAAGCTGCGCAGCGTGCCA GTCTGAGCTCC (SEQ ID NO: 372) |
| MJ_oligo_187_LD | 38 | L | TCTAATACGACTCACTATAGGAGCTCAGACTGGCAC GC (SEQ ID NO: 373) |
| MJ_oligo_189_LD | 20 | L | GTGGAACCGACAACTTGTGC (SEQ ID NO: 374) |

14.2 PCR Reactions

15 µl PCR reactions contain 0.2 mM each of the four L-dNTP's, 10 nM 83-mer ssDNA (MJ_1_105_LD) template, 1 µM of forward and reverse primer, 1x ThermoPol buffer (Invitrogen, 20 mM Tris-HCl, 10 mM KCl, 10 mM $(NH_4)_2SO_4$, 2 mM $MgSO_4$, 0.1% Triton X-100, pH 8.8@25° C.) and at least 0.67 ng/µl all-D polymerase Dpo4 variant A155C/V203C. The forward primer is MJ_oligo_187_LD yielding a PCR product of 102 bp, which is distinguishable from the 83-mer template. The reverse primer is MJ_oligo_89_LD. The L-dNTP's are purchased as custom synthesis by Rasayan, Inc. (Encinitas, Calif., USA).

Negative controls are conducted by omitting the all-D polymerase Dpo4 variant A155C/V203C.

The thermal cycling program consists of 1 cycle (85° C., 3 min) then at least 7 cycles (85° C., 30 sec/56° C., 1 min/60° C., 4 min) then hold at 4° C. 4 µl aliquots of the PCR reactions are mixed with sample loading buffer and analyzed on TBE gels. A DNA standard ladder containing, among others, a 100 bp band is applied on the gel.

14.3 Activity Confirmation

The PCR reaction with all-D polymerase Dpo4 variant A155C/V203C and L-DNA substrate and L-nucleotides yields a band in the range of about 100 bp as compared with the DNA standard ladder. Said band does not appear in the negative controls, where polymerase is omitted. Also said 102 bp band migrates higher than the 83-mer template. The all-D polymerase Dpo4 variant A155C/V203C dependent appearance of an L-DNA amplification product thus confirms the activity of the synthetic all-D polymerase Dpo4 variant A155C/V203C in a thermal amplification process.

Example 15—Synthesis of D- or L-Nucleic Acids

L-DNA nucleic acids or D-DNA nucleic acids were produced by solid-phase synthesis with an ABI 394 synthesizer (Applied Biosystems, Foster City, Calif., USA) using 2'TBDMS DNA phosphoramidite chemistry with standard exocyclic amine protecting groups (Damha and Ogilvie, 1993). For the DNA synthesis dA(N-Bz)-, dC(N-Ac)-, dG(N-ibu)-, and dT in the D- and L-configuration were applied. All phosphoramidites were purchased from ChemGenes, Wilmington, Mass. After synthesis and deprotection L-DNA nucleic acids or D-DNA nucleic acids were purified by gel electrophoresis.

REFERENCES

The complete bibliographic data of the documents recited herein are, if not indicated to the contrary, as follows, whereby the disclosure of said references is incorporated herein by reference.

Altschul S. F., Gish W., et al. (1990) Basic local alignment search tool. J Mol Biol. 215(3):403-10.

Altschul S. F., Madden T. L., et al. (1997) Gapped BLAST and PSI-BLAST: a new generation of protein database search programs. Nucleic Acids Res. 25(17):3389-402.

Atherton E., Logan C. J. and Sheppard R. C. (1981) Peptide synthesis. Part 2. Procedures for solid-phase synthesis using Nu-fluorenylmethoxycarbonylamino-acids on polyamide supports. Synthesis of substance P and of acyl carrier protein 65-74 decapeptide J. Chem. Soc., Perkin Trans. 1, 538-546

Barlos, K., Gatos, D., Kallitsis, J., Papaphotiu, G., Sotiriu, P., Yao, W. Q. and Schäfer, W. (1989) Darstellung geschatzter Peptid-Fragmente unter Einsatz substituierter Triphenylmethyl-Harze. Tetrahedron Letters. 30(30): 3943-3946

Bock L. C., Griffin L. C., Latham J. A., Vermaas E. H. and Toole J. J. (1992) Selection of single-stranded DNA molecules that bind and inhibit human thrombin. Nature. 355(6360):564-6.

Boudsocq, F., S. Iwai, et al. (2001). "*Sulfolobus solfataricus* P2 DNA polymerase IV (Dpo4): an archaeal DinB-like DNA polymerase with lesion-bypass properties akin to eukaryotic poleta." Nucleic Acids Res 29(22): 4607-16.

Burmeister P. E. et al (2006) 2'-Deoxy purine, 2'-O-methyl pyrimidine (dRmY) aptamers as candidate therapeutics. Oligonucleotides. 16(4):337-51.

Damha M J, Ogilvie K K. (1993) Oligoribonucleotide synthesis. The silyl-phosphoramidite method. Methods Mol Biol. 20:81-114

Garcia-Echeverria, C. (1995) On the use of hydrophobic probes in the chromatographic purification of solid-phase synthesized peptides. J. Chem. Soc., Chem. Commun. 779-780

Ellington A. D. and Szostak J. W. (1990) In vitro selection of RNA molecules that bind specific ligands. Nature. 346(6287):818-22.

Freier S. M. and Altmann K. H. (1997) The ups and downs of nucleic acid duplex stability: structure-stability studies on chemically-modified DNA:RNA duplexes. Nucleic Acids Res. 25(22):4429-43.

Klussmann S. (2006). The Aptamer Handbook—Functional Oligonucleotides and their Applications. Edited by S. Klussmann. WILEY-VCH, Weinheim, Germany, ISBN 3-527-31059-2

Klussmann S., Nolte A., Bald R., Erdmann V. A. and Fürste J. P. (1996) Mirror-image RNA that binds D-adenosine. Nat Biotechnol. 14(9):1112-5.

Kusser W. (2000) Chemically modified nucleic acid aptamers for in vitro selections: evolving evolution. J Biotechnol 74(1): 27-38.

Mairal T., Ozalp V. C., Lozano Sánchez P., et al. (2008) Aptamers: molecular tools for analytical applications. Anal Bioanal Chem. 390(4):989-1007

Mandal K., Uppalapati M., Ault-Riché D., Kenney J., Lowitz J., Sidhu S. S. and Kent S. B. H. (2012) Chemical synthesis and X-ray structure of a heterochiral {D-protein antagonist plus vascular endothelial growth factor} protein complex by racemic crystallography. PNAS. 109(37)

McGinnis S., Madden T. L. et al. (2004) BLAST: at the core of a powerful and diverse set of sequence analysis tools. Nucleic Acids Res. 32(Web Server issue):W20-5.

Needleman and Wunsch (1970) A general method applicable to the search for similarities in the amino acid sequence of two proteins. J Mol Biol. 48(3):443-53.

Nolte A., Klussmann S., Bald R., Erdmann V. A. and Fürste J. P. (1996) Mirror-design of L-oligonucleotide ligands binding to L-arginine. Nat Biotechnol. 14(9):1116-9.

Oliveros, M., R. J. Yanez, et al. (1997). "Characterization of an African swine fever virus 20-kDa DNA polymerase involved in DNA repair." J Biol Chem 272(49): 30899-910.

Pearson and Lipman (1988) Improved tools for biological sequence comparison. Proc. Nat'l. Acad. Sci. USA 85: 2444

Sambrook et al. (ed.), (1989) Molecular Cloning: A Laboratory Manual, 2nd ed., vol. 1-3, Cold Spring Harbor Laboratory Press, Cold Spring Harbor, N.Y.

Sekizaki, H., Itoh, K., Toyota, E. and Tanizawa, K. (1996) Synthesis and tryptic hydrolysis of p-guanidinophenyl esters derived from amino acids and peptides. Chemical & Pharmaceutical Bulletin. 44(8):1577-9

Sekizaki, H., Itoh, K., Toyota, E. and Tanizawa, K. (1996) Trypsin-catalyzed peptide synthesis and various p-guanidinophenyl esters as acyl donors. Chemical & Pharmaceutical Bulletin. 44(8):1585-7

Sharma, I. and Crich, D. (2011) Direct Fmoc-Chemistry-Based Solid-Phase Synthesis of Peptidyl Thioesters. Journal of Organic Chemistry. 76(16):6518-24

Smith and Waterman (1981), Adv. Appl. Math. 2: 482

Tuerk C. and Gold L. (1990) Systematic evolution of ligands by exponential enrichment: RNA ligands to bacteriophage T4 DNA polymerase. Science. 249(4968):505-10.

Usman N. and Cedergren R. (1992) Exploiting the chemical synthesis of RNA. Trends Biochem Sci. 17(9):334-9

Venkatesan N., Kim S. J., et al. (2003) Novel phosphoramidite building blocks in synthesis and applications toward modified oligonucleotides. Curr Med Chem 10(19): 1973-91

Wincott F, DiRenzo A, et al. (1995). Synthesis, deprotection, analysis and purification of RNA and ribozymes. Nucleic Acids Res.; 23(14):2677-84.

Zheng J., Tang S., et al. (2013) Chemical synthesis of proteins using peptide hydrazides as thioester surrogates. Nature Protocols, 8(12), 2483-95

The features of the present invention disclosed in the specification, the claims and/or the drawings may both separately and in any combination thereof be material for realizing the invention in various forms thereof.

SEQUENCE LISTING (375 sequences)

SEQ ID NO: 1 - protein, 174 aa, African swine fever virus
MLTLIQGKKIVNHLRSRLAFEYNGQLIKILSKNIVAVGSLRREEKMLNDVDLLIIVPEKKLLKHVLPNIRIKGLSFSVKVCGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 2 - protein, 174 aa, Artificial
  Synthetic
MLTLIQGKKIVNHLRSRLAFEYNGQLIKILSKNIVAVGSLRREEKMLNDVDLLIIVPEKKLLKHVLPNIRIKGLSFSVKGCGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 3 - protein, 174 aa, Artificial
  Synthetic
MLTLIQGKKIVNHLRSRLAFEYNGQLIKILSKNIVAVGSLRREEKMLNDVDLLIIVPEKKLLKHVLPNIRIKGLSFSVKACGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 4 - protein, 174 aa, Artificial
  Synthetic
MLTLIQGKKIVNHLRSRLAFEYNGQLIKILSKNIVAVGSLRREEKMLNDVDLLIIVPEKKLLKHVLPNIRIKGLSFSVKVCGERKCVLFIEWEKKTYQLDLFTALAEEKPYAIFHFTGPVSYLGRIRAALKKKNYKLNQYGLFKNQTLVPLKITTEKELIKELGFTYRIPKKRL

SEQ ID NO: 5 - protein, 174 aa, Artificial
  Synthetic
MLTLIQGKKIVNHLRSRLAFEYNGQLIKILSKNIVAVGSLRREEKMLNDVDLLIIVPEKKLLKHVLPNIRIKGLSFSVKVCGERKSVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 6 - DNA, 17 bp, Artificial
  Synthetic
  misc_feature (1)..(2): D-nucleotide
  misc_feature (3)..(17): L-nucleotide
gggatcacagtgagtac

SEQ ID NO: 7 - DNA, 17 bp, Artificial
  Synthetic
  misc_feature (1)..(17): L-nucleotide
  misc_feature (1)..(1): Phosphate attached
gtaaaacgacggccagt

SEQ ID NO: 8 - DNA, 33 bp, Artificial
  Synthetic
  misc_feature (1)..(33): L-nucleotide
actggccgtcgttttacagtactcactgtgatc

SEQ ID NO: 9 - DNA, 33 bp, Artificial
  Synthetic
  misc_feature (1)..(33): L-nucleotide
actggccgtcgttttaccgtactcactgtgatc

SEQ ID NO: 10 - DNA, 33 bp, Artificial
  Synthetic
  misc_feature (1)..(33): L-nucleotide
actggccgtcgttttacggtactcactgtgatc

SEQ ID NO: 11 - DNA, 33 bp, Artificial
  Synthetic
  misc_feature (1)..(33): L-nucleotide
actggccgtcgttttactgtactcactgtgatc

SEQ ID NO: 12 - DNA, 17 bp, Artificial
  Synthetic
  misc_feature (1)..(2): D-nucleotide
  misc_feature (3)..(17): L-nucleotide
gggatcacagtgagtac

SEQ ID NO: 13 - DNA, 12 bp, Artificial
  Synthetic
  misc_feature (1)..(12): L-nucleotide
  misc_feature (1)..(1): Phosphate attached
acgacggccagt

SEQ ID NO: 14 - DNA, 33 bp, Artificial
  Synthetic
  misc_feature (133)..(): L-nucleotide
actggccgtcgttctattgtactcactgtgatc

SEQ ID NO: 15 - protein, 352 aa, Sulfolobus solfataricus
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 16 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 17 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 18 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 19 - protein, 352 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 20 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 21 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 22 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 23 - DNA, 83 bp, Artificial
  Synthetic
  misc_feature (1)..(83): L-nucleotide
gtggaaccgacaacttgtgctgcgtccagcataagaaaggagctccctcagaagaagctgcgcagcgtgccagtctgagctcc

SEQ ID NO: 24 - DNA, 38 bp, Artificial
  Synthetic
  misc_feature (1)..(38): L-nucleotide
tctaatacgactcactataggagctcagactggcacgc

SEQ ID NO: 25 - DNA, 20 bp, Artificial
  Synthetic
  misc_feature (1)..(20): L-nucleotide
gtggaaccgacaacttgtgc

SEQ ID NO: 26 - DNA, 528 bp, Artificial
  Synthetic
atgctgaccctgattcagggcaaaaaaatcgtgaaccatctgcgtagccgtctggcctttgaatataacggccagctgattaaaattctgagcaaaaacattgtggcggtgggcagcctgcgtcgtgaagaaaaaatgctgaacgatgtggatctgctgattattgtgccggaaaaaaaactgctgaaacatgtgctgccgaacattcgtattaaaggcctgagctttagcgtgaaagtgtgcggcgaacgtaaatgcgtgctgtttatcgaatgggaaaaaaaaacctaccagctggacctgtttaccgcgctggccgaagaaaaaccgtatgcgatctttcattttaccggtccggtgagctatctgattcgtattcgtgcggcgctgaaaaaaaaaaactacaaactgaaccagtatggcctgtttaaaaaccagaccctggtgccgctgaaaattaccaccgaaaaagaactgattaaagaactgggctttacctatcgcattccgaaaaaacgcctgtaataa

SEQ ID NO: 27 - protein, 210 aa, Artificial
  Synthetic
MRGSHHHHHHGMASMTGGQQMGRDLYDDDDKDRWGSMLTLIQGKKIVNHLRSRLAFEYNGQLIKILSKNIVAVGSLRREEKMLNDVDLLIIVPEKKLLKHVLPNIRIKGLSFSVKVCGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 28 - DNA, 34 bp, Artificial
  Synthetic
tccggtgagctatctgggtcgtattcgtgcggcg

SEQ ID NO: 29 - DNA, 34 bp, Artificial
  Synthetic
cgccgcacgaatacgacccagatagctcaccgga

SEQ ID NO: 30 - DNA, 31 bp, Artificial
  Synthetic
tgagctttagcgtgaaagggtgcggcgaacg

SEQ ID NO: 31 - DNA, 31 bp, Artificial
  Synthetic
cgttcgccgcaccctttcacgctaaagctca

SEQ ID NO: 32 - DNA, 31 bp, Artificial
  Synthetic
tgagctttagcgtgaaagcgtgcggcgaacg

SEQ ID NO: 33 - DNA, 31 bp, Artificial
  Synthetic
cgttcgccgcacgctttcacgctaaagctca

SEQ ID NO: 34 - DNA, 36 bp, Artificial
  Synthetic
tgaaagtgtgcggcgaacgtaaaagcgtgctgttta

SEQ ID NO: 35 - DNA, 36 bp, Artificial
  Synthetic
taaacagcacgcttttacgttcgccgcacactttca

SEQ ID NO: 36 - DNA, 15 bp, Artificial
  Synthetic
gatcacagtgagtac

SEQ ID NO: 37 - DNA, 17 bp, Artificial
  Synthetic
  misc_feature (1)..(1): Phosphate attached
gtaaaacgacggccagt

SEQ ID NO: 38 - DNA, 33 bp, Artificial; identical to SEQ ID NO: 8
  Synthetic

SEQ ID NO: 39 - DNA, 33 bp, Artificial; identical to SEQ ID NO: 9
  Synthetic

SEQ ID NO: 40 - DNA, 33 bp, Artificial; identical to SEQ ID NO: 10
  Synthetic

SEQ ID NO: 41 - DNA, 33 bp, Artificial; identical to SEQ ID NO: 11
  Synthetic

SEQ ID NO: 42 - DNA, 12 bp, Artificial
  Synthetic
  misc_feature (1)..(1): Phosphate attached
acgacggccagt

SEQ ID NO: 43 - protein, 39 aa, Artificial
  Synthetic
  MISC_FEATURE (1)..(1): Ac attached
  MISC_FEATURE (39)..(39): 4-guanidinphenol attached
MLTLIQGKKIVNHLRSRLAFEYNGQLIKILSKNIVAVGS

SEQ ID NO: 44 - protein, 40 aa, Artificial
  Synthetic
  MISC_FEATURE (40)..(40): SMe attached
RREEKMLNDVDLLIIVPEKKLLKHVLPNIRIKGLSFSVKA

SEQ ID NO: 45 - protein, 94 aa, Artificial
  Synthetic
CGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 46 - protein, 80 aa, Artificial
  Synthetic
  MISC_FEATURE (1)..(1): Ac attached
  MISC_FEATURE (80)..(80): SMe attached
MLTLIQGKKIVNHLRSRLAFEYNGQLIKILSKNIVAVGSLRREEKMLNDVDLLIIVPEKKLLKHVLPNIRIKGLSFSVKA

SEQ ID NO: 47 - DNA, 19 bp, Artificial
  Synthetic
  misc_feature (1)..(1): Atto532 attached
ggagctcagactggcacgc

SEQ ID NO: 48 - DNA, 83 bp, Artificial; identical to SEQ ID NO: 23
  Synthetic

SEQ ID NO: 49 - DNA, 21 bp, Artificial
  Synthetic
  misc_feature (1)..(2): D-nucleotide
  misc_feature (3)..(21): L-nucleotide
ggggagctcagactggcacgc

SEQ ID NO: 50 - DNA, 1056 bp, Artificial
  Synthetic
atgattgtgctgtttgtggattttgattatttttatgcccaggtggaagaagttctgaatccgagcctgaaaggtaaaccggttgttgtttgtgtttttagcggtcgctttgaagatagcggtgcagttgcaaccgccaattatgaagcccgtaaatttggtgttaaagccggtattccgattgttgaagccaaaaaaattctgccgaatgcagtttatctgccgatgcgcaaagaagtttatcagcaggttagcagccgtattatgaatctgctgcgcgaatatagcgaaaaaattgaaattgccagcattgatgaagcctatctggatattagcgataaagtgcgcgattatcgcgaagcatataatctgggcctggaaattaaaaataaaatcctggaaaaagaaaaaattaccgtgaccgtgggcattagcaaaaataaagtgtttgccaaaattgcagcagatatggcaaaaccgaatggcattaaagtgattgatgatgaagaagtgaaacgtctgattcgcgaactggatattgcagatgttccgggtattggcaatattaccgcagaaaaactgaaaaaactgggcattaataaactggttgataccctgagcattgaatttgataaactgaaaggcatgattggtgaagcgaaagccaaatatctgattagcctggcacgtgatgaatataatgaaccgattcgtacccgtgttcgtaaaagcattggtcgtattgtgaccatgaaacgcaatagccgtaatctggaagaaattaaaccgtacctgtttcgtgcaattgaagaaagctattataaactggataaacgcattccgaaagccattcatgttgttgcagttaccgaagatctggatattgttagccgtggtcgtacctttccgcatggtattagcaaagaaaccgcctatagcgaaagcgttaaactgctgcagaaaatcctggaagaagatgaacgtaaaattcgtcgtattggtgtgcgctttagcaaatttattgaagccattggcctggataaattttttgatacc

SEQ ID NO: 51 - protein, 368 aa, Artificial
  Synthetic
MASAWSHPQFEKSGMIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDTGS

SEQ ID NO: 52 - DNA, 59 bp, Artificial
  Synthetic
caaaaataaagtgtttgccaaaattgcatgcgatatggcaaaaccgaatggcattaaag

SEQ ID NO: 53 - DNA, 59 bp, Artificial
  Synthetic
ctttaatgccattcggttttgccatatcgcatgcaattttggcaaacactttatttttg

SEQ ID NO: 54 - DNA, 51 bp, Artificial
  Synthetic
tgaaaaaactgggcattaataaactgtgtgataccctgagcattgaatttg

SEQ ID NO: 55 - DNA, 51 bp, Artificial
  Synthetic
caaattcaatgctcagggtatcacacagtttattaatgcccagttttttca

SEQ ID NO: 56 - DNA, 39 bp, Artificial
  Synthetic
tgaaaggtaaaccggttgttgtttctgtttttagcggtc

SEQ ID NO: 57 - DNA, 39 bp, Artificial
  Synthetic
gaccgctaaaaacagaaacaacaaccggtttacctttca

SEQ ID NO: 58 - DNA, 46 bp, Artificial
  Synthetic
atgcgcaaagaagtttatcagcaggtttgtagccgtattatgaatc

SEQ ID NO: 59 - DNA, 46 bp, Artificial
  Synthetic
gattcataatacggctacaaacctgctgataaacttctttgcgcat

SEQ ID NO: 60 - DNA, 43 bp, Artificial
  Synthetic
aagtttatcagcaggttagctgtcgtattatgaatctgctgcg

SEQ ID NO: 61 - DNA, 43 bp, Artificial
  Synthetic
cgcagcagattcataatacgacagctaacctgctgataaactt

SEQ ID NO: 62 - DNA, 51 bp, Artificial
  Synthetic
attatgaatctgctgcgcgaatattgtgaaaaaattgaaattgccagcatt

SEQ ID NO: 63 - DNA, 51 bp, Artificial
  Synthetic
aatgctggcaatttcaattttttcacaatattcgcgcagcagattcataat

SEQ ID NO: 64 - DNA, 36 bp, Artificial
  Synthetic
  misc_feature (1)..(1): Phosphate attached
agcggctcttcgatgattgtgctgtttgtggatttt

SEQ ID NO: 65 - DNA, 36 bp, Artificial
  Synthetic
  misc_feature (1)..(1): Phosphate attached
agcggctcttcggcatgcaattttggcaaacacttt

SEQ ID NO: 66 - DNA, 27 bp, Artificial
  Synthetic
  misc_feature (1)..(1): Phosphate attached
agcggctcttcgtgcatcacgggagat

SEQ ID NO: 67 - DNA, 42 bp, Artificial
  Synthetic
  misc_feature (1)..(1): Phosphate attached
agcggctcttcgcccttgaagctgccacaaggcaggaacgtt

SEQ ID NO: 68 - protein, 154 aa, Artificial
  Synthetic
  MISC_FEATURE (154)..(154): Thioester
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIA

SEQ ID NO: 69 - DNA, 36 bp, Artificial
  Synthetic
  misc_feature (1)..(1): Phosphate attached
agcggctcttcgatgggagggaaatcaaacggggaa

SEQ ID NO: 70 - DNA, 36 bp, Artificial
  Synthetic
  misc_feature (1)..(1): Phosphate attached
agcggctcttcggcacaaagctttgaagagcttgtc

SEQ ID NO: 71 - DNA, 42 bp, Artificial
  Synthetic
  misc_feature (1)..(1): Phosphate attached
agcggctcttcgtgcgatatggcaaaaccgaatggcattaaa

SEQ ID NO: 72 - DNA, 40 bp, Artificial
  Synthetic
  misc_feature (1)..(1): Phosphate attached
agcggctcttcgcccttaggtatcaaaaaatttatccagg

SEQ ID NO: 73 - protein, 198 aa, Artificial
  Synthetic
CDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 74 - DNA, 36 bp, Artificial
  Synthetic
  misc_feature (1)..(1): Phosphate attached
agcggctcttcgtgtgataccctgagcattgaattt

SEQ ID NO: 75 - protein, 150 aa, Artificial
  Synthetic
CDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 76 - DNA, 36 bp, Artificial
  Synthetic
  misc_feature (1)..(1): Phosphate attached
agcggctcttcgatggcagatatggcaaaaccgaat

SEQ ID NO: 77 - DNA, 36 bp, Artificial
  Synthetic
  misc_feature (1)..(1): Phosphate attached
agcggctcttcggcacagtttattaatgcccagttt

SEQ ID NO: 78 - protein, 48 aa, Artificial
  Synthetic
  MISC_FEATURE (48)..(48): Thioester
ADMAKPNGIKVIDDEEVKRLIRELDIADVPGIGNITAEKLKKLGINKL

SEQ ID NO: 79 - DNA, 38 bp, Artificial; identical to SEQ ID NO: 24
  Synthetic

SEQ ID NO: 80 - DNA, 20 bp, Artificial
  Synthetic
gtggaaccgacaacttgtgc

SEQ ID NO: 81 - protein, 53 aa, Artificial
  Synthetic
  MISC_FEATURE (53)..(53): NH2
RTFPHGISKETAYSESVKLLQKILEEDERKIRRIGVRFSKFIEAIGLDKFFDT

SEQ ID NO: 82 - protein, 97 aa, Artificial
  Synthetic
  MISC_FEATURE (1)..(1): Boc attached
VDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRG

SEQ ID NO: 83 - protein, 150 aa, Artificial
  Synthetic
  MISC_FEATURE (150)..(150): NH2
VDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 84 - protein, 47 aa, Artificial
  Synthetic
  MISC_FEATURE (1)..(1): Z group attached
  MISC_FEATURE (47)..(47): benzyl-thioester
CDMAKPNGIKVIDDEEVKRLIRELDIADVPGIGNITAEKLKKLGINK

SEQ ID NO: 85 - protein, 78 aa, Artificial
  Synthetic
  MISC_FEATURE (78)..(78): SMe attached
RKEVYQQVSSRIMNLLREYSEKIEIASIDEAYLDISDKVRDYREAYNLGLEIKNKILEKEKITVTVGISKNKVFAKIA

SEQ ID NO: 86 - protein, 76 aa, Artificial
  Synthetic
  MISC_FEATURE (1)..(1): Ac attached
  MISC_FEATURE (76)..(76): 4-guanidinphenol attached
MIVLFVDFDYFYAQVEEVLNPSLKGKPVVVCVFSGRFEDSGAVATANYEARKFGVKAGIPIVEAKKILPNAVYLPM

SEQ ID NO: 87 - protein, 198 aa, Artificial
  Synthetic
CDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 88 - protein, 154 aa, Artificial; identical to SEQ ID NO: 68
  Synthetic
  MISC_FEATURE (1)..(1): Ac attached
  MISC_FEATURE (154)..(154): SMe attached

SEQ ID NO: 89 - protein, 352 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 90 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 91 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 92 - protein, 352 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 93 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 94 - protein, 352 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 95 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 96 - protein, 352 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 97 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 98 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 99 - protein, 352 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 100 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 101 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 102 - protein, 352 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 103 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 104 - protein, 352 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 105 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 106 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 107 - protein, 352 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 108 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 109 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 110 - protein, 352 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 111 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 112 - protein, 352 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 113 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 114 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 115 - protein, 352 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 116 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 117 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 118 - protein, 352 aa, Artificial; identical to SEQ ID NO: 104
  Synthetic

SEQ ID NO: 119 - protein, 352 aa, Artificial; identical to SEQ ID NO: 112
  Synthetic

SEQ ID NO: 120 - protein, 352 aa, Artificial; identical to SEQ ID NO: 96
  Synthetic

SEQ ID NO: 121 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 122 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 123 - protein, 349 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 124 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 125 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 126 - protein, 349 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 127 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 128 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 129 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 130 - protein, 349 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 131 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 132 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 133 - protein, 349 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 134 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 135 - protein, 349 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 136 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 137 - protein, 349 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 138 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 139 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 140 - protein, 349 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 141 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 142 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 143 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 144 - protein, 349 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 145 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 146 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 147 - protein, 349 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 148 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 149 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 150 - protein, 349 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 151 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 152 - protein, 349 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 153 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 154 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 155 - protein, 349 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 156 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 157 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 158 - protein, 349 aa, Artificial; identical to SEQ ID NO: 144
  Synthetic

SEQ ID NO: 159 - protein, 349 aa, Artificial; identical to SEQ ID NO: 152
  Synthetic

SEQ ID NO: 160 - protein, 349 aa, Artificial; identical to SEQ ID NO: 137
  Synthetic

SEQ ID NO: 161 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 162 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 163 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 164 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 165 - protein, 346 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 166 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 167 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 168 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 169 - protein, 346 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 170 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 171 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 172 - protein, 346 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 173 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 174 - protein, 346 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 175 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 176 - protein, 346 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 177 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 178 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 179 - protein, 346 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 180 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 181 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 182 - protein, 346 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 183 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 184 - protein, 346 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 185 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 186 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 187 - protein, 346 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 188 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 189 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 190 - protein, 346 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 191 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 192 - protein, 346 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 193 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 194 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 195 - protein, 346 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 196 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 197 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 198 - protein, 346 aa, Artificial; identical to SEQ ID NO: 184
  Synthetic

SEQ ID NO: 199 - protein, 346 aa, Artificial; identical to SEQ ID NO: 192
  Synthetic

SEQ ID NO: 200 - protein, 346 aa, Artificial; identical to SEQ ID NO: 176
  Synthetic

SEQ ID NO: 201 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 202 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 203 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 204 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 205 - protein, 343 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 206 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 207 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 208 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 209 - protein, 343 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 210 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 211 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 212 - protein, 286 aa, Artificial
  Synthetic
GIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 213 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 214 - protein, 343 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 215 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 216 - protein, 343 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 217 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 218 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 219 - protein, 343 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 220 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 221 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 222 - protein, 343 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 223 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 224 - protein, 343 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 225 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 226 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 227 - protein, 343 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 228 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 229 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 230 - protein, 343 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 231 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 232 - protein, 343 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 233 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 234 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 235 - protein, 343 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 236 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 237 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 238 - protein, 343 aa, Artificial; identical to SEQ ID NO: 224
  Synthetic

SEQ ID NO: 239 - protein, 343 aa, Artificial; identical to SEQ ID NO: 232
  Synthetic

SEQ ID NO: 240 - protein, 343 aa, Artificial; identical to SEQ ID NO: 216
  Synthetic

SEQ ID NO: 241 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 242 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 243 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 244 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 245 - protein, 340 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 246 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 247 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 248 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 249 - protein, 340 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 250 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 251 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 252 - protein, 340 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 253 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 254 - protein, 340 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 255 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 256 - protein, 340 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 257 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 258 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 259 - protein, 340 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 260 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 261 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 262 - protein, 340 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 263 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 264 - protein, 340 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 265 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 266 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 267 - protein, 340 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 268 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 269 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 270 - protein, 340 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 271 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 272 - protein, 340 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 273 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 274 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 275 - protein, 340 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 276 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 277 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 278 - protein, 340 aa, Artificial; identical to SEQ ID NO: 264
  Synthetic

SEQ ID NO: 279 - protein, 340 aa, Artificial; identical to SEQ ID NO: 272
  Synthetic

SEQ ID NO: 280 - protein, 340 aa, Artificial; identical to SEQ ID NO: 256
  Synthetic

SEQ ID NO: 281 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 282 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 283 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 284 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 285 - protein, 337 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 286 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 287 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 288 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYCEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 289 - protein, 337 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 290 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 291 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 292 - protein, 337 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 293 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 294 - protein, 337 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 295 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 296 - protein, 337 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 297 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 298 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 299 - protein, 337 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 300 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 301 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 302 - protein, 337 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 303 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 304 - protein, 337 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 305 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 306 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 307 - protein, 337 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 308 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 309 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 310 - protein, 337 aa, Artificial
  Synthetic
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 311 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSCRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 312 - protein, 337 aa, Artificial
  Synthetic
MIVLFVDFDYFYAQVEEVLNPSLKGKPVVVSVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 313 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 314 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPARKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 315 - protein, 337 aa, Artificial
  Synthetic
MIVLFVDFDYFYAQVEEVLNPSLKGKPVVVCVFSGRFEDSGAVATANYEARKFGVKAGIPIVEAKKCLPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 316 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSGRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 317 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVSSRIMNLLREYGEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 318 - protein, 337 aa, Artificial; identical to SEQ ID NO: 304
  Synthetic

SEQ ID NO: 319 - protein, 337 aa, Artificial; identical to SEQ ID NO: 312
  Synthetic

SEQ ID NO: 320 - protein, 337 aa, Artificial; identical to SEQ ID NO: 296
  Synthetic

SEQ ID NO: 321 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 322 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 323 - protein, 352 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKFFDT

SEQ ID NO: 324 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 325 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 326 - protein, 349 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 327 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 328 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 329 - protein, 346 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGL

SEQ ID NO: 330 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 331 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 332 - protein, 343 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEA

SEQ ID NO: 333 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 334 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 335 - protein, 340 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKF

SEQ ID NO: 336 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 337 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 338 - protein, 337 aa, Artificial
  Synthetic
MIVLFVDFDYFYAQVEEVLNPSLKGKPVVVCVFSGRFEDSGAVATANYEARKFGVKAGIPIVEAKKILPNAVYLPMRKEVYQQVCSRIMNLLREYSEKIEIASIDEAYLDISDKVRDYREAYNLGLEIKNKILEKEKITVTVGISKNKVFAKIACDMAKPNGIKVIDDEEVKRLIRELDIADVPGIGNITAEKLKKLGINKLCDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRF

SEQ ID NO: 339 - protein, 352 aa, Sulfolobus islandicus
MIILFVDFDYFYAQVEEVLNPSLKGKPVVVCVFSGRFEDSGAVATANYEARKFGIKAGISIVEAKKILPNAVYLPMRKEVYQQVSNRIMKLLREYSEKIEIASIDEAYLDISDKVKNYQDAYNLGLEIKNKILEKEKITVTVGISKNKVFAKIAADMAKPNGIKVIDDEEVKRLIVELDIADIPGIGDITAEKLKKLGVNKLVDTLRIEFDELKGIIGEAKAKYLFSLARDEYNEPIRARVRKSIGRIVTMKRNSRDLEEIKPYLFRAIEEAYYKLDKKIPKAIHVVAVTEDLDIVSRGRTFTHGISKETAYREAVRLLQKILEEDERKIRRIGVRFSKFIEAIGLDKFFDT

SEQ ID NO: 340 - protein, 352 aa, Sulfolobus shibatae
MIILFVDFDYFYAQVEEVLDTSLKGKPVVVCVFSGRFEDSGAVATANYEARKFGIKAGIPIVEAKKILPNAVYLPMRKEVYQQVSNRIMRLLREYSEKIEIASIDEAYLDISDKVKDYQEAYNLGLEIKNKILEKEKITVTVGISKNKVFAKIAADMAKPNGIKVIDNDEVKRLIRELDIGDVPGVGSITAEKLKKLGVNKLVDTLRVEFGELKRIIGEAKAKYLYSLARDEYNEPIRARVRKSIGRIVTMKRNSRDLEEIKPYLFRAIEEAYHKLDKKIPKAIHVVAITEDLDIVSRGRTFTHGISKETAYKEAVKLLQKILEEDERKIRRIGVRFSKFIEAIGLDRFFNT

SEQ ID NO: 341 - protein, 352 aa, Sulfolobus tengchongensis
MIILFVDFDYFYAQVEEVLNPSLKGKPVVVCVFSGRTENSGAVATANYEARKLGVKAGMPIVKAKEILPDAIYLPMRKEVYQQVSNRIMNILRKYSRKIEIASIDEAYLDISDKVNNYTDAYKIGLQIKNEIYEKEKITVTVGISKNKVFAKIAAEMAKPNGIKVIDDNEVKKLIREIDIGEIPGVGEITTQKLKSLGINKLIDILNFDFMKIKKIVGEAKANYLFSLARDEYFGPVKERVRKSIGRIVTLKKNSRNIEEIKPFLARSLDEAFNKLNGKIPKTIYLVAVMEDLDIISRGKTFPHGITKETAYKASLELLEKLLAEDKRKIRRIGVRFSKFIEATSLDKFFQF

SEQ ID NO: 342 - protein, 351 aa, Sulfolobus tokodaii
MIILFVDFDYFFAQVEEVLNPQYKGKPLIVCVYSGRNEKSGAVATANYEARKLGVKAGMPISRAMELAPNAIFVPMHKEVYTEVSNRIMSIISSYSDKIEIASIDEAYIDITSKVKNFEEAIELGKKLKREIMEKEKITVTVGIAPNKVFAKIIADRVKPNGLGVVKPEEIEEFIKSIDIDEVPGVGNVISERLHSLGVNKLIDILSVSFDKLKEEIGEAKAFYLYRLATNSYFEPVLNKERVPHGRYLTLPKNTRDIKVIELYLKKAIDEAYNKIEGIPKRMTVVTIMQDLDIVSKSKTFKTGISKERAYTESIELLKQILQKDSRLVRRVGVRFDNIYKSKGLDVFFNS

SEQ ID NO: 343 - protein, 354 aa, Sulfolobus acidocaldarius
MIVIFVDFDYFFAQVEEVLNPQYKGKPLVVCVYSGRTKTSGAVATANYEARKLGVKAGMPIIKAMQIAPSAIYVPMRKPIYEAFSNRIMNLLNKHADKIEVASIDEAYLDVTNKVEGNFENGIELARKIKQEILEKEKITVTVGVAPNKILAKIIADKSKPNGLGVIRPTEVQDFLNELDIDEIPGIGSVLARRLNELGIQKLRDILSKNYNELEKITGKAKALYLLKLAQNKYSEPVENKSKIPHGRYLTLPYNTRDVKVILPYLKKAINEAYNKVNGIPMRITVIAIMEDLDILSKGKKFKHGISIDNAYKVAEDLLRELLVRDKRRNVRRIGVKLDNIIINKTNLSDFFDI

SEQ ID NO: 344 - protein, 84 aa, Artificial Sequence
  Synthetic
  MISC_FEATURE (1)..(84): D-amino acids
  MISC_FEATURE (1)..(1): H at N-terminus
  MISC_FEATURE (84)..(84): SBzl at C-terminus
CVYLPMRKEVYQQVSSRIMNLLREYSEKIEIASIDEAYLDISDKVRDYREAYNLGLEIKNKILEKEKITVTVGISKNKVFAKIA

SEQ ID NO: 345 - protein, 70 aa, Artificial Sequence
  Synthetic
  MISC_FEATURE (1)..(70): D-amino acids
  MISC_FEATURE (1)..(1): Ac at N-terminus
  MISC_FEATURE (70)..(70): SBzl at C-terminus
MIVLFVDFDYFYAQVEEVLNPSLKGKPVVVCVFSGRFEDSGAVATANYEARKFGVKAGIPIVEAKKILPN

SEQ ID NO: 346 - protein, 154 aa, Artificial Sequence
  Synthetic
  MISC_FEATURE (1)..(154): D-amino acids
  MISC_FEATURE (1)..(1): Ac at N-terminus
  MISC_FEATURE (154)..(154): SBzl at C-terminus
MIVLFVDFDYFYAQVEEVLNPSLKGKPVVVCVFSGRFEDSGAVATANYEARKFGVKAGIPIVEAKKILPNCVYLPMRKEVYQQVSSRIMNLLREYSEKIEIASIDEAYLDISDKVRDYREAYNLGLEIKNKILEKEKITVTVGISKNKVFAKIA

SEQ ID NO: 347 - protein, 76 aa, Artificial Sequence
  Synthetic
  MISC_FEATURE (1)..(76): D-amino acids
  MISC_FEATURE (1)..(1): Ac at N-terminus
  MISC_FEATURE (76)..(76): OGp at C-terminus
MIVLFVDFDYFYAQVEEVLNPSLKGKPVVVCVFSGRFEDSGAVATANYEARKFGVKAGIPIVEAKKILPNAVYLPG

SEQ ID NO: 348 - protein, 78 aa, Artificial Sequence; identical to SEQ ID NO: 85
  Synthetic
  MISC_FEATURE (1)..(78): D-amino acids
  MISC_FEATURE (1)..(1): H at N-terminus
  MISC_FEATURE (78)..(78): SBzl at C-terminus

SEQ ID NO: 349 - protein, 154 aa, Artificial Sequence
  Synthetic
  MISC_FEATURE (1)..(154): D-amino acids
  MISC_FEATURE (1)..(1): Ac at N-terminus
  MISC_FEATURE (154)..(154): CBzl at C-terminus
MIVLFVDFDYFYAQVEEVLNPSLKGKPVVVCVFSGRFEDSGAVATANYEARKFGVKAGIPIVEAKKILPNAVYLPGRKEVYQQVSSRIMNLLREYSEKIEIASIDEAYLDISDKVRDYREAYNLGLEIKNKILEKEKITVTVGISKNKVFAKIA

SEQ ID NO: 350 - protein, 71 aa, Artificial Sequence
  Synthetic
  MISC_FEATURE (1)..(71): D-amino acids
  MISC_FEATURE (1)..(1): H at N-terminus
  MISC_FEATURE (71)..(71): NH2 at C-terminus
KAIHVVAVTEDLDIVSRGRTFPHGISKETAYSESVKLLQKILEEDERKIRRIGVRFSKFIEAIGLDKFFDT

SEQ ID NO: 351 - protein, 79 aa, Artificial Sequence
  Synthetic
  MISC_FEATURE (1)..(79): D-amino acids
  MISC_FEATURE (1)..(1): H at N-terminus
  MISC_FEATURE (79)..(79): OH at C-terminus
CDTLSIEFDKLKGMIGEAKAKYLISLARDEYNEPIRTRVRKSIGRIVTMKRNSRNLEEIKPYLFRAIEESYYKLDKRIP

SEQ ID NO: 352 - protein, 84 aa, Artificial Sequence; identical to SEQ ID NO: 344
  Synthetic
  MISC_FEATURE (1)..(84): D-amino acids
  MISC_FEATURE (1)..(1): H at N-terminus
  MISC_FEATURE (84)..(84): NHNH2 at C-terminus

SEQ ID NO: 353 - DNA, 47 bp, Artificial Sequence
  Synthetic
agccaaaaaaattctgccgaattgtgtttatctgccgatgcgcaaag

SEQ ID NO: 354 - DNA, 47 bp, Artificial Sequence
  Synthetic
ctttgcgcatcggcagataaacacaattcggcagaatttttttggct

SEQ ID NO: 355 - DNA, 42 bp, Artificial Sequence
  Synthetic
cgaatgcagtttatctgccggggcgcaaagaagtttatcagc

SEQ ID NO: 356 - DNA, 42 bp, Artificial Sequence
  Synthetic
gctgataaacttctttgcgccccggcagataaactgcattcg

SEQ ID NO: 357 - DNA, 42 bp, Artificial Sequence
  Synthetic
cgaatgcagtttatctgccggcgcgcaaagaagtttatcagc

SEQ ID NO: 358 - DNA, 42 bp, Artificial Sequence
  Synthetic
gctgataaacttctttgcgcgccggcagataaactgcattcg

SEQ ID NO: 359 - DNA, 43 bp, Artificial Sequence
  Synthetic
ggtattccgattgttgaagccaaaaaatgtctgccgaatgcag

SEQ ID NO: 360 - DNA, 43 bp, Artificial Sequence
  Synthetic
ctgcattcggcagacattttttggcttcaacaatcggaatacc

SEQ ID NO: 361 - DNA, 37 bp, Artificial Sequence
  Synthetic
gtttatcagcaggttagcggccgtattatgaatctgc

SEQ ID NO: 362 - DNA, 37 bp, Artificial Sequence
  Synthetic
gcagattcataatacggccgctaacctgctgataaac

SEQ ID NO: 363 - protein, 368 aa, Artificial Sequence
  Synthetic
  MISC_FEATURE (1)..(368): L-amino acids
MASWSHPQFEKGAETAVPNSIVLFVDFDYFYAQVEEVLNPSLKGKPVVVCVFSGRFEDSGAVATANYEARKFGVKAGIPIVEAKKILPNAVYLPMRKEVYQQVSSRIMNLLREYSEKIEIASIDEAYLDISDKVRDYREAYNLGLEIKNKILEKEKITVTVGISKNKVFAKIAADMAKPNGIKVIDDEEVKRLIRELDIADVPGIGNITAEKLKKLGINKLVDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRGRTFPHGISKETAYSESVKLLQKILEEDERKIRRIGVRFSKFIEAIGLDKF

SEQ ID NO: 364 - DNA, 41 bp, Artificial Sequence
  Synthetic
tattggtgtgcgctttagcaaattttaataaggtacccggg

SEQ ID NO: 365 - DNA, 41 bp, Artificial Sequence
  Synthetic
cccgggtaccttattaaaatttgctaaagcgcacaccaata

SEQ ID NO: 366 - DNA, 34 bp, Artificial Sequence
  Synthetic
gtattggtgtgcgcttttaataaggtacccgggg

SEQ ID NO: 367 - DNA, 34 bp, Artificial Sequence
  Synthetic
ccccgggtaccttattaaaagcgcacaccaatac

SEQ ID NO: 368 - protein, 97 aa, Artificial Sequence
  Synthetic
  MISC_FEATURE (1)..(97): D-amino acids
  MISC_FEATURE (1)..(1): Boc at N-terminus
  MISC_FEATURE (97)..(97): OH at C-terminus
CDTLSIEFDKLKGMIGEAKAKYLISLARDEYNEPIRTRVRKSIGRIVTMKRNSRNLEEIKPYLFRAIEESYYKLDKRIPKAIHVVAVTEDLDIVSRG

SEQ ID NO: 369 - protein, 150 aa, Artificial Sequence; identical to SEQ ID NO: 75
  Synthetic
  MISC_FEATURE (1)..(150): D-amino acids
  MISC_FEATURE (1)..(1): H at N-terminus
  MISC_FEATURE (150)..(150): NH2 at C-terminus

SEQ ID NO: 370 - protein, 48 aa, Artificial Sequence
  Synthetic
  MISC_FEATURE (1)..(48): D-amino acids
  MISC_FEATURE (1)..(1): lipo at N-terminus
  MISC_FEATURE (48)..(48): 4-Acetamidothiophenylester at C-terminus
CDMAKPNGIKVIDDEEVKRLIRELDIADVPGIGNITAEKLKKLGINKL

SEQ ID NO: 371 - protein, 154 aa, Artificial Sequence; identical to SEQ ID NO: 346
  Synthetic
  MISC_FEATURE (1)..(154): D-amino acids
  MISC_FEATURE (1)..(1): Ac at N-terminus
  MISC_FEATURE (154)..(154): NHNH2 at C-terminus

SEQ ID NO: 372 - DNA, 83 bp, Artificial Sequence; identical to SEQ ID NO: 23
  Synthetic

SEQ ID NO: 373 - DNA, 38 bp, Artificial Sequence; identical to SEQ ID NO: 24
  Synthetic

SEQ ID NO: 374 - DNA, 20 bp, Artificial Sequence
  Synthetic
gtggaaccgacaacttgtgc

SEQ ID NO: 375 - protein, 198 aa, Artificial Sequence; identical to SEQ ID NO: 87
  Synthetic
  MISC_FEATURE (1)..(198): D-amino acids
  MISC_FEATURE (1)..(1): H at N-terminus
  MISC_FEATURE (198)..(198): NH2 at C-terminus

The invention claimed is:

1. A polymerase, wherein said polymerase comprises an amino acid sequence other than that of SEQ ID NO:15, wherein amino acids of the amino acid sequence are D-amino acids, wherein said polymerase adds one or more L-nucleotides to the 3' end of a first L-nucleic acid or amplifies a target L-nucleic acid in the presence of L-nucleotides, wherein said polymerase comprises an amino acid sequence of SEQ ID NO:89 or SEQ ID NO:94 or an amino acid sequence at least 85% identical to SEQ ID NO:89 or SEQ ID NO:94.

2. A method: (a) for adding one or more L-nucleotides to the 3' end of a first L-nucleic acid comprising reacting the one or more L-nucleotides with the first L-nucleic acid in the presence of the polymerase of claim 1, wherein said polymerase adds one or more L-nucleotides to the 3' end of the first L-nucleic acid; or (b) for amplifying a target L-nucleic acid in the presence of L-nucleotides comprising reacting the L-nucleotides with the target L-nucleic acid in presence of said polymerase of claim 1, wherein said polymerase amplifies the target L-nucleic acid in the presence of L-nucleotides.

3. The polymerase according to claim 1, wherein said polymerase comprises an amino acid sequence according to any one of SEQ ID NOs:121, 161, 201, 241 or 281.

4. The polymerase according to claim 3, wherein the amino acid sequence of said polymerase differs from the amino acid sequence of any one of SEQ ID NOs:121, 161, 201, 241 or 281 at the following position(s) of the amino acid sequence according to any one of SEQ ID NOs:121, 161, 201, 241 or 281 or at amino acid position(s) corresponding thereto:
   a) amino acid position 155 and/or 203 and/or 71,
   b) amino acid position 155 and/or 203 and/or 86,
   c) amino acid position 155 and/or 203 and/or 31,
   d) amino acid position 155 and/or 203 and/or 76,
   e) amino acid position 155 and/or 203 and/or 67,
   f) amino acid position 155 and/or 203 and/or 96, or
   g) amino acid position 155 and/or 203 and/or 85,
   wherein in any one of a) to g), the amino acid at positions 155, 203, 71, 67, 85 and 96 is substituted by cysteine, the amino acid at position 31 is substituted by serine, the amino acid at position 76 is substituted by glycine or alanine, and the amino acid at position 86 is substituted by glycine or cysteine.

5. The polymerase according to claim 1, wherein said polymerase comprises an amino acid sequence according to SEQ ID NO:339 or SEQ ID NO:340.

6. The polymerase according to claim 1, wherein the amino acid sequence of said polymerase comprises an amino acid sequence according to any one of SEQ ID NOs:122 to 160, 162 to 200, 202 to 240, 242 to 280, or 282 to 338.

7. The polymerase according to claim 5, wherein the amino acid sequence of said polymerase differs from the amino acid sequence of SEQ ID NO:339 or SEQ ID NO:340 at the following position(s) of the amino acid sequence of SEQ ID NO:339 or SEQ ID NO:340, or at amino acid position(s) corresponding thereto:
   a) amino acid position 155 and/or 203 and/or 71,
   b) amino acid position 155 and/or 203 and/or 86,
   c) amino acid position 155 and/or 203 and/or 31,
   d) amino acid position 155 and/or 203 and/or 76,
   e) amino acid position 155 and/or 203 and/or 67,
   f) amino acid position 155 and/or 203 and/or 96, or
   g) amino acid position 155 and/or 203 and/or 85,
   wherein in any one of a) to g), the amino acid at positions 155, 203, 71, 67, 85 and 96 is substituted by cysteine, the amino acid at position 31 is substituted by serine, the amino acid at position 76 is substituted by glycine or alanine, and the amino acid at position 86 is substituted by glycine or cysteine.

8. A method for the identification of a target molecule binding L-nucleic acid molecule comprising the following steps of:
   (a) generating a heterogeneous population of L-nucleic acid molecules;

(b) contacting the heterogeneous population of L-nucleic acid molecules of step (a) with the target molecule;
(c) separating the L-nucleic acid molecules which are not bound by the target molecule; and
(d) amplifying the L-nucleic acid molecules which are bound by the target molecule with said polymerase according to claim 1.

9. The polymerase of claim 1 comprising an amino acid substitution at position 155.

10. The polymerase of claim 1, wherein A at position 155 is replaced by C.

11. The polymerase of claim 1 comprising an amino acid substitution at position 203.

12. The polymerase of claim 1, wherein V at position 203 is replaced by C.

13. The polymerase of claim 1 comprising amino acid substitutions at positions 71 and 155.

14. The polymerase of claim 1 comprising amino acid substitutions at positions 71 and 203.

15. The polymerase of claim 1 comprising amino acid substitutions at positions 71, 155 and 203.

* * * * *

UNITED STATES PATENT AND TRADEMARK OFFICE
CERTIFICATE OF CORRECTION

PATENT NO. : 11,634,741 B2  
APPLICATION NO. : 15/038049  
DATED : April 25, 2023  
INVENTOR(S) : Pech et al.

Page 1 of 1

It is certified that error appears in the above-identified patent and that said Letters Patent is hereby corrected as shown below:

On the Title Page

Item (73) for the Assignee, delete, "Munich" and replace with, -- Berlin --.

Signed and Sealed this  
Eleventh Day of February, 2025

Coke Morgan Stewart  
*Acting Director of the United States Patent and Trademark Office*